(12) United States Patent
Schlingensiepen et al.

(10) Patent No.: US 6,972,171 B1
(45) Date of Patent: Dec. 6, 2005

(54) ANTISENSE OLIGONUCLEOTIDE PREPARATION METHOD

(75) Inventors: Karl-Hermann Schlingensiepen, Göttingen (DE); Wolfgang Brysch, Göttingen (DE)

(73) Assignee: Biognostik Ges. fur biomolekulare Diagnostik mbH, Gottingen (DE)

( * ) Notice: Subject to any disclaimer, the term of this patent is extended or adjusted under 35 U.S.C. 154(b) by 0 days.

(21) Appl. No.: 09/341,700

(22) PCT Filed: Jan. 30, 1998

(86) PCT No.: PCT/EP98/00497

§ 371 (c)(1),
(2), (4) Date: Sep. 24, 1999

(87) PCT Pub. No.: WO98/33904

PCT Pub. Date: Aug. 6, 1998

(30) Foreign Application Priority Data

Jan. 31, 1997 (EP) .............................. 97101531

(51) Int. Cl.[7] .......................... C12Q 1/68; C12P 19/34; C07H 21/02; C07H 21/04
(52) U.S. Cl. ......................... 435/6; 435/91.1; 435/91.5; 536/23.1; 536/24.5
(58) Field of Search .......................... 435/6, 91.1, 91.5, 435/455, 325, 375; 536/23.1, 24.5, 25.3; 514/44

(56) References Cited

U.S. PATENT DOCUMENTS 5,801,154 A * 9/1998 Baracchini et al. ............ 514/44
5,948,888 A * 9/1999 de la Monte et al. ........ 530/350

FOREIGN PATENT DOCUMENTS

| WO | WO90/10030 | 9/1990 |
| WO | WO93/07883 | 4/1993 |
| WO | WO94/25588 | 11/1994 |
| WO | WO95/00103 | 1/1995 |
| WO | WO95/02422 | 1/1995 |
| WO | WO96/31600 | 10/1996 |
| WO | WO96/39415 | 12/1996 |

OTHER PUBLICATIONS

Stull et al. Nucleic Acids Res. (1992) vol. 20, No. 13: 3501–3508.*
Probst et al. Trends in Gen. (1996) vol. 12, No. 8: 290–291.*
Toon F.C.M. Smetsers et al., Sense and Nucleic Acid Drug Development, 6: pp. 63–67.*
Stanley T. Crooke, Therapeutic Applications of Oligonucleotides, Annu. Rev. Pharmacol. Toxicol, 1992, 32, pp. 329–376.*
James, W. Antiviral Chem. and Chemotherapy, vol. 2, No. 4, pp. 191–214, 1991.*
Milner et al. Nature Biotech., vol. 15, pp. 537–541. 1997.*
Ehrlich et al. Antisense Res. and Dev., vol. 4, pp. 173–183, 1994.*
Vaerman et al. Blood, vol. 90, No. 1, pp. 331–339, 1997.*
Branch, A. Trends in Biochem. Sci., vol. 23, pp. 45–50, 1997.*

Crooke, S.T. Antisense Res. and Application, Chapter 1, pp. 1–50, Published by Springer–Verlag, 1998.*
Verma et al. Nature, vol. 389, pp. 239–243, 1997.*
Crystal, R.G. Science, vol. 270, pp. 404–410, 1995.*
Friedmann, T. Scientific American, June Volume, pp. 96–101, 1997.*
Yu et al., "Hybrid Oligonucleotides: Synthesis, Biophysical Properties, Stability Studies, and Biological Activity," *Bioorganic & Medicinal Chemistry*, 4 (10) : 1685–1692 (1996).
Zhao et al., "Effect of Different Chemically Modified Oligodeoxynucleotides on Immune Stimulation," *Biochemical Pharmacology*, 51 (2) : 173–182 (1996).
Hatzfeld, "Release of Early Human Hematopoietic Progenitors from Quiescence by Antisense Transforming Growth Factor β1 or Rb Oligonucleotides," *Journal of Experimental Medicine*, 174 (4) : 925–929 (1991).
Fitzpatrick, et al., "Antisense Oligonucleotides Specific for Transforming Growth Factor β2 Inhibit the Growth of Malignant Mesothelioma Both in Vitro and in Vivo," *Cancer Research*, 57 : 3200–3207 (1997).
Pisetsky et al., "Stimulation of in vitro proliferation of murine lymphocytes by synthetic oligonucleotides, " *Molecular Biology Reports*, 18 (3) :217–221 (1993).
Jachimczak et al., "Transforming growth factor β–mediated autocrine growth regulation of gliomas as detected with phosphorothioate antisense oligonucleotides," *International Journal of Cancer*, 65 (3) :332–337 (1996).
Jachimczak et al., "The effect of transforming growth factor $β_2$–specific phosphorothioate–anti–sense oligonucleotides in reversing cellular immunosuppression in malignant glioma," 78 : 944–951 (1993).
Agrawal, "Antisense oligonucleotides: towards clinical trials," *Trends in Biotechnology*, 14(10) :376–387 (1996).

* cited by examiner

Primary Examiner—Ram R. Shukla
Assistant Examiner—Jane Zara
(74) Attorney, Agent, or Firm—Jacobson Holman PLLC

(57) ABSTRACT

A method for the preparation of an antisense oligonucleotide or derivative thereof comprising the steps of: selecting a target nucleic acid, if necessary elucidating its sequence; generating the antisense oligonucleotide with the proviso that: the oligonucleotide comprises at least 8 residues; the oligonucleotide comprises at maximum twelve elements, which are capable of forming three hydrogen bonds each to cytosine bases; the oligonucleotide does not contain four or more consecutive elements, capable of forming three hydrogen bonds each with four consecutive cytosine bases (CCCC) within the target molecule or alternatively four or more consecutive elements of GGGG; the oligonucleotide does also not contain 2 or more series of three consecutive elements, capable of forming three hydrogen bonds each with three consecutive cytosine bases (CCC) within the target molecule, or alternatively 2 or more series of three consecutive elements of GGG; and the ratio between residues forming two hydrogen bonds per residue (2H-bond-R) with the target molecule and those residues forming three hydrogen bonds per residue (3H-bond-R) with the target molecule, is ruled by the following specifications: 3H-bond-R/3H-bond-R+2H-bond-R ≧ 0.29, and synthesizing the oligonucleotide thus generated in a per se known manner.

9 Claims, 36 Drawing Sheets

Adenine

Guanine

Cytosine

Thymine

FIG. 3-1

Figure 1:
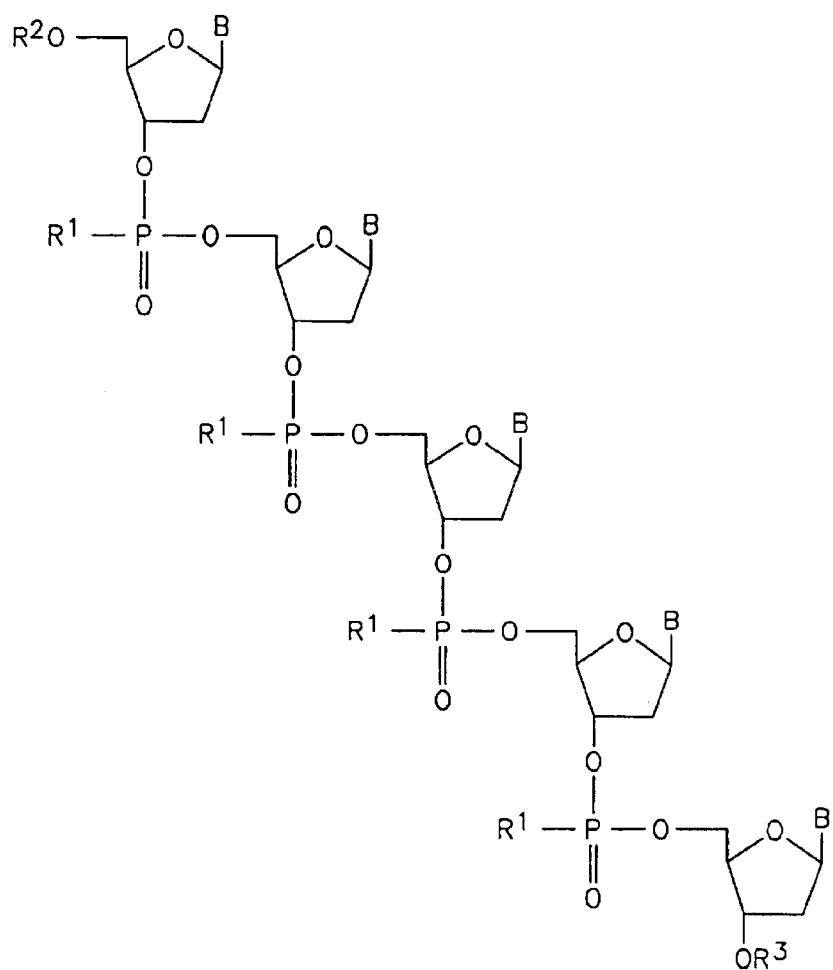
Figure 1:
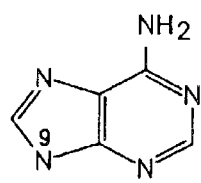
Figure 1:
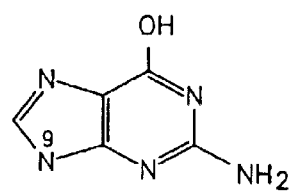
Figure 1:
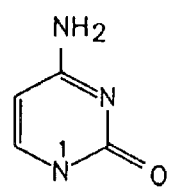
Figure 1:
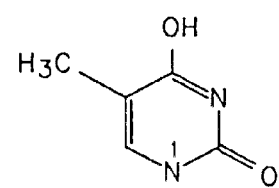

| # | ID | Sequence |
|---|---|---|
| 1. | A3 | CCCGGAGGGCGGCATGGGGGA |
| 2. | N1 | CCTCAGGGAGAAGGGCGC |
| 3. | N2 | GTAGGAGGGCCTCGAGGG |
| 4. | N3 | CTGCAGGGGCTGGGGGTC |
| 5. | N4 | AGGGCTGGTTGTGGTGGGG |
| 6. | N5 | GGCATGGGGGAGGCGGCG |
| 7. | N6 | CCGGAGGGCGGCATGGGG |
| 8. | N7 | GGGGGGCTGGCGAGCCGC |
| 9. | N8 | GGACAGGATCTGGCCGCGGATGG |
| 10. | N9 | CCCCCTGGCTCGGGGGGC |
| 11. | N10 | GGGCCGGGCGGCACCTCC |
| 12. | N11 | GGGCAGCGGGCCGGGCGG |
| 13. | N12 | ACGGCCTCGGGCAGCGGG |
| 14. | N13 | GGGTGCTGTTGTACAGGG |
| 15. | N14 | GGGTTTCCACCATTAGCACGCGGG |
| 16. | N15 | TCATAGATTTCGTT |
| 17. | N16 | TTGTCATAGATTT |
| 18. | N17 | AAGAACATATATATG |
| 19. | N18 | AAGAACATATATAT |
| 20. | N19 | TTGAAGAACATATATA |
| 21. | N20 | CCGGGAGAGCAACACGGG |
| 22. | N21 | ACTTTTAACTTGA |
| 23. | N22 | ATTGTTGCTGTATTT |
| 24. | N23 | ATTGTTGCTGTATT |
| 25. | N24 | AATTGTTGCTGTATT |
| 26. | N25 | AATTGTTGCTGTAT |
| 27. | N26 | GGCGAGTCGCTGGGTGCCAGCAGCCGG |
| 28. | N27 | GGCGAGTCGCTGGG |
| 29. | N28 | ACATCAAAAGATAA |
| 30. | N29 | TGACATCAAAAGAT |
| 31. | N30 | GGGCCCTCTCCAGCGGGG |
| 32. | N31 | GGGCTCGGCGGTGCCGGG |
| 33. | N32 | GGGGCAGGGCCCGAGGCA |
| 34. | N33 | GGCTCCAAATGTAGGGGC |
| 35. | N34 | CGGGTTATGCTGGTTGTACAGGGC |
| 36. | N35 | CGGCGCCGCCGAGGCGCCCGGG |
| 37. | N36 | GGGGCGGGGCGGGACC |
| 38. | N37 | GGGCGGGGCGGGGCGGG |
| 39. | N38 | GGGCGGGGTGGGGCCGGG |
| 40. | N39 | GGCAAGGCAGCGGGGGCGGGG |
| 41. | TGF-β1-1 | CGGTAGCAGCAGCG |
| 42. | TGF-β1-2 | CCAGTAGCCACAGC |
| 43. | TGF-β1-3 | GCAGGTGGATAGTCC |
| 44. | TGF-β1-4 | CTTGCAGGTGGATAG |
| 45. | TGF-β1-5 | CGATAGTCTTGCAGG |
| 46. | TGF-β1-6 | CCATGTCGATAGTCTTGC |
| 47. | TGF-β1-7 | CTCGATGCGCTTCCG |
| 48. | TGF-β1-8 | CCTCGATGCGCTTCC |
| 49. | TGF-β1-9 | GGATGGCCTCGATGC |
| 50. | TGF-β1-10 | GGACAGGATCTGGCC |
| 51. | TGF-β1-11 | CGCAGCTTGGACAGG |
| 52. | TGF-β1-12 | GAGCCGCAGCTTGG |
| 53. | TGF-β1-13 | CGAGCCGCAGCTTG |
| 54. | TGF-β1-14 | ACCTCCCCCTGGCT |
| 55. | TGF-β1-15 | CCACCATTAGCACG |
| 56. | TGF-β1-16 | GAACTTGTCATAGATTTC |
| 57. | TGF-β1-17 | GCTGTGTGTACTCTGC |
| 58. | TGF-β1-18 | GCTCCACGTGCTGC |
| 59. | TGF-β1-19 | GAATTGTTGCTGTATTTC |
| 60. | TGF-β1-20 | GCCAGGAATTGTTGC |
| 61. | TGF-β1-21 | GTGACATCAAAAGATAAC |
| 62. | TGF-β1-22 | GGCTCAACCACTGCC |
| 63. | TGF-β1-23 | GCTGTCACAGGAGC |
| 64. | TGF-β1-24 | CCTGCTGTCACAGG |
| 65. | TGF-β1-25 | GCAGTGTGTTATCCCTGC |
| 66. | TGF-β1-26 | GCAGTGTGTTATCCC |

FIG. 3-2

| # | Name | Sequence |
|---|---|---|
| 67. | TGF-β1-27 | CCAGGTCACCTCGG |
| 68. | TGF-β1-28 | GCCATGAATGGTGGC |
| 69. | TGF-β1-29 | GCCATGAATGGTGG |
| 70. | TGF-β1-30 | CCATGAGAAGCAGG |
| 71. | TGF-β1-31 | GGAAGTCAATGTACAGC |
| 72. | TGF-β1-32 | CCACGTAGTACACGATGG |
| 73. | TGF-β1-33 | GCACTTGCAGGAGC |
| 74. | p53-1 | CCATGGCAGTGACC |
| 75. | p53-2 | GGCTCCTCCATGGC |
| 76. | p53-3 | GCTAGGATCTGACTGC |
| 77. | p53-4 | CCTGACTCAGAGGG |
| 78. | p53-5 | GGTCTGAAAATGTTTCC |
| 79. | p53-6 | CCATTGCTTGGGACGG |
| 80. | p53-7 | GCATCAAATCATCC |
| 81. | p53-8 | CCATTGTTCAATATCG |
| 82. | p53-9 | GGTCTTCAGTGAACC |
| 83. | p53-10 | GGAGCTTCATCTGGACC |
| 84. | p53-11 | CCTCTGGCATTCTGG |
| 85. | p53-12 | AGGGACAGAGATG |
| 86. | p53-13 | GTTTTCTGGGAAGG |
| 87. | p53-14 | GGTTTTCTGGGAAG |
| 88. | p53-15 | AGGTTTCTGGGAAG |
| 89. | p53-16 | GTAGGTTTTCTGGG |
| 90. | p53-17 | GGTAGGTTTTCTGG |
| 91. | p53-18 | CCAGAATGCAAGAAGCC |
| 92. | p53-19 | GCTGTCCCAGAATGC |
| 93. | p53-20 | GCAAGTCACAGACTTGGC |
| 94. | p53-21 | CCACAGCTGCACAGG |
| 95. | p53-22 | GGTGTGGAATCAACC |
| 96. | p53-23 | GTCATGTGCTGTGA |
| 97. | p53-24 | CGCTATCTGAGCAGCG |
| 98. | p53-25 | CCAGTGTGATGATGG |
| 99. | p53-26 | CCAGTAGATTACCACTGG |
| 100. | p53-27 | GGCACAAACACGCACC |
| 101. | p53-28 | CCACGGATCTGAAGG |
| 102. | p53-29 | CGGAACATCTCGAAGCG |
| 103. | p53-30 | CCTCATTCAGCTCTCGG |
| 104. | p53-31 | CCTTGAGTTCCAAGG |
| 105. | p53-32 | CCTTTTTGGACTTCAGG |
| 106. | p53-33 | GGAGGTAGACTGACCC |
| 107. | p52-N-1 | AAAATGTTTCCT |
| 108. | p52-N-2 | TGAAAATGTTTC |
| 109. | p52-N-3 | CTGAAAATGTTT |
| 110. | p52-N-4 | TCTGAAAATGTTT |
| 111. | p52-N-5 | TCTGAAAATGTT |
| 112. | p52-N-6 | AAATCATCCATT |
| 113. | p52-N-7 | TTGTTCAATATC |
| 114. | p52-N-8 | ATTGTTCAATATC |
| 115. | p52-N-9 | ATTGTTCAATAT |
| 116. | p52-N-10 | CATTGTTCAATAT |
| 117. | p52-N-11 | CATTGTTCAATA |
| 118. | p52-N-12 | AAAAGTGTTCT |
| 119. | p52-N-13 | ACATGATTTTTAT |
| 120. | p52-N-14 | AACATGAGTTTTTAT |
| 121. | p52-N-15 | ACATGAGTTTTTA |
| 122. | p52-N-16 | AACATGAGTTTTTA |
| 123. | p52-N-17 | AACATGAGTTTTTT |
| 124. | p52-N-18 | AAAACATCTTGTT |
| 125. | p53-T-1 | CAGAGGGGGCTCGACGC |
| 126. | p53-T-2 | CTGACTCAGAGGGGGCTC |
| 127. | p53-T-3 | AGGGGGACAGAACG |
| 128. | p53-T-4 | TTGGGACGGCAAGGGGGACAGAA |
| 129. | p53-T-5 | TGGGACGGCAAGGGGGA |

FIG. 3-3

| # | Name | Sequence |
|---|------|----------|
| 130. | p53-T-6 | GCCACGGGGGGAGCA |
| 131. | p53-T-7 | GCAGGGGCCACGGGGGGAG |
| 132. | p53-T-8 | AGGGGCCACGGGGG |
| 133. | p53-T-9 | CAGGGGCCACGGGG |
| 134. | p53-T-10 | GGTGCAGGGGCCACG |
| 135. | p53-T-11 | TGGTGCAGGGGCCGCCGG |
| 136. | p53-T-12 | GGGGCTGGTGCAGGGGCC |
| 137. | p53-T-13 | AGGGGGCTGGTGCAGGGG |
| 138. | p53-T-14 | GGGCTGGTGCAGGG |
| 139. | p53-T-15 | GAGGGGGCTGGTGCAG |
| 140. | p53-T-16 | AGGAGGGGCTGGTG |
| 141. | p53-T-17 | GGGCCAGGAGGGGGCTGG |
| 142. | p53-T-18 | AGGGGCCAGGAGGGGGCT |
| 143. | p53-T-19 | GGGGCCAGGAGGGG |
| 144. | p53-T-20 | CAGGGGCCAGGAGGG |
| 145. | p53-T-21 | TCTGGGAAGGGACAGA |
| 146. | p53-T-22 | TGAGGGCAGGGCAGTA |
| 147. | p53-T-23 | TTGAGGGCAGGGGAG |
| 148. | p53-T-24 | CGGGTGCCGGGCGGGGGTG |
| 149. | p53-T-25 | CGGACGCGGGTGCCGGGCGGGGGT |
| 150. | p53-T-26 | CGGGTGCCGGGCGGG |
| 151. | p53-T-27 | GGACGCGGGTGCCGGGCG |
| 152. | p53-T-28 | TGGGGGCAGCGCCTCACA |
| 153. | p53-T-29 | GGTGGGGGCAGCGCCT |
| 154. | JunB-1 | CCATTTTAGTGCACATCCGG |
| 155. | JunB-2 | CCATTTTAGTGCACATCC |
| 156. | JunB-3 | GCTGTTCCATTTTAGTGC |
| 157. | JunB-4 | GTAGTCGTGTAGAG |
| 158. | JunB-5 | GTTTGTAGTCGTGTAG |
| 159. | JunB-6 | GTTTCAGGAGTTTGTAG |
| 160. | JunB-7 | CCAGCTCCGAAGAGG |
| 161. | JunB-8 | CGTCGTCGTGATCACG |
| 162. | JunB-9 | GGTAAAAGTACTGTTCC |
| 163. | JunB-10 | GGCTTTGACAAAGCC |
| 164. | JunB-11 | CTTGTGCAGATCGTCCAG |
| 165. | JunB-12 | CGTGGTTCATCTTGTGC |
| 166. | JunB-13 | CACGTGGTTCATCTTGTG |
| 167. | JunB-14 | CCTCCTTGAAGGTGG |
| 168. | JunB-15 | CGCTCCACTTTGATGCG |
| 169. | JunB-16 | CCTTGTCCTCCAGG |
| 170. | JunB-17 | GGTACTCGACAGCC |
| 171. | JunB-18 | CTGACGTGGGTCATG |
| 172. | JunB-19 | CCGTTGCTGACGTGG |
| 173. | JunD-1 | CATCCTCCGCCTCC |
| 174. | JunD-2 | GTTTCCATCCTCCG |
| 175. | JunD-3 | GGTGTTCCATCCTCC |
| 176. | JunD-4 | GGTGTTTCCATCCTC |
| 177. | JunD-5 | GCTCAGCGCCTCATC |
| 178. | JunD-6 | CCTTCTTCATCATGCTGC |
| 179. | JunD-7 | CCTTCTTCATCATGCTG |
| 180. | JunD-8 | CCTTCTTCATCATGC |
| 181. | JunD-9 | GCGTCCTTCTTCATCATGC |
| 182. | JunD-10 | CCTGCTCACTCAGG |
| 183. | JunD-11 | CGCAGGCTTGAGCG |
| 184. | JunD-12 | GCCAGCTTCAGCAGC |
| 185. | JunD-13 | GGTGGTGACCAGCC |
| 186. | JunD-14 | CCTCGGCGAACTCC |
| 187. | JunD-15 | GCTTGTGTAAATCC |
| 188. | JunD-16 | GGTTCTGCTTGTGTAAATCC |
| 189. | JunD-17 | GCTGCTCAGGTTCGC |
| 190. | JunD-18 | GAAGGCGACCGTCG |
| 191. | JunD-19 | CGAAGGCCACCGTC |
| 192. | JunD-20 | GCACCGTCTGTGCC |
| 193. | JunD-21 | CGTGTCCATGTCGATGG |
| 194. | JunD-22 | CGTGTCCATGTCGATG |

FIG. 3-4

| | | |
|---|---|---|
| 195. | JunD-23 | GCGTGTCCATGTCG |
| 196. | JunD-24 | CCAGCTTGCGCTTGC |
| 197. | JunD-25 | CGCTCCAGCTTGCG |
| 198. | JunD-26 | CGTGTTCTGACTCTTGAG |
| 199. | JunD-27 | CGTGTTCTGACTCTTG |
| 200. | JunD-28 | GCTGTTGACGTGGC |
| 201. | JunD-29 | CGACTCAGTACGCC |
| 202. | JunD-30 | GCCATGCCCGACTC |
| 203. | JunD-31 | CCCTTGGAGGTGGC |
| 204. | JunB-N-1 | TTTTAGTGCACAT |
| 205. | JunB-N-2 | TGTTCCATTTTAGT |
| 206. | JunB-N-3 | AAAAAAAGTGGAAG |
| 207. | JunB-N-4 | TACAAAAAAAAGTG |
| 208. | JunB-N-5 | ATACAAAAAAAAGT |
| 209. | JunB-N-6 | CATACAAAAAAAAGT |
| 210. | JunB-N-7 | CATACAAAAAAAAG |
| 211. | JunB-N-8 | GAAAAAAAACATAC |
| 212. | JunB-N-9 | CAGAAAAAAAAACATAC |
| 213. | JunB-N-10 | CAGAAAAAAAAACAT |
| 214. | JunB-N-11 | TTCAATATGAATCG |
| 215. | JunB-N-12 | TATTCAATATGAATCG |
| 216. | JunB-N-13 | TATTCAATATGAATC |
| 217. | JunB-N-14 | TATTCAATATGAAT |
| 218. | JunB-N-15 | TATATTCAATATGAA |
| 219. | JunB-N-16 | TTATATTCAATATGA |
| 220. | JunB-N-17 | TATTATATTCAATATGA |
| 221. | JunB-N-18 | TTATATTCAATATG |
| 222. | JunB-N-19 | TATTATATTCAATATG |
| 223. | JunB-N-20 | ATTATATTCAATAT |
| 224. | JunB-N-21 | TATTATATTCAATAT |
| 225. | JunB-N-22 | ATATATTATATTCAATAT |
| 226. | JunB-N-23 | AAATATATTATATTCAATAT |
| 227. | JunB-N-24 | TATTATATTCAATA |
| 228. | JunB-N-25 | ATATATTATATTCAATA |
| 229. | JunB-N-26 | CAAATATATTATATTCAATA |
| 230. | JunB-N-27 | TATATTATATTCAAT |
| 231. | JunB-N-28 | AATATATTATATTCAAT |
| 232. | JunB-N-29 | TATATTATATTCAA |
| 233. | JunB-N-30 | CAAATATATTATATTCAA |
| 234. | JunB-N-31 | CAAATATATTATATTCA |
| 235. | JunB-N-32 | CAAATATATTATATTC |
| 236. | JunB-N-33 | CACAAATATATTATATTC |
| 237. | JunB-N-34 | AAATATATTATATT |
| 238. | JunB-N-35 | CAAATATATTATATT |
| 239. | JunB-N-36 | CAAATATATTATAT |
| 240. | JunB-N-37 | CACAAATATATTATAT |
| 241. | JunB-N-38 | CACAAATATATTAT |
| 242. | JunB-N-39 | TACACAAATATATTAT |
| 243. | JunB-N-40 | TACACAAATATATTA |
| 244. | JunB-N-41 | TAAATACACAAATATATT |
| 245. | JunB-N-42 | AATACACAAATATA |
| 246. | JunB-N-43 | GTTAAATACACAAATA |
| 247. | JunB-N-44 | TGTTAAATACACAA |
| 248. | JunB-N-45 | TTTAGAGACTAAGT |
| 249. | JunB-N-46 | ATAAACTCTTTAGA |
| 250. | JunB-N-47 | TAAAATAAACTCTTTAG |
| 251. | JunB-N-48 | TAAAATAAACTCTTTA |
| 252. | JunB-N-49 | TTAAAATAAACTCTTT |
| 253. | JunB-N-50 | CTTAAAATAAACTC |
| 254. | JunB-N-51 | TAAAAAGAACAAACA |
| 255. | JunB-N-52 | TAAAAAAGAACAAAC |
| 256. | JunB-N-53 | CAATAAAAAGAACAA |
| 257. | JunB-N-54 | TCAATAAAAAGAACAA |
| 258. | JunB-N-55 | TCAATAAAAAGAAC |
| 259. | JunB-N-56 | TTCAATAAAAAGAA |
| 260. | JunB-N-57 | TAGATTCAATAAAAAGA |

FIG. 3-5

| # | Name | Sequence |
|---|---|---|
| 261. | JunB-T-1 | TGGCGCGGGCGGGTAGC |
| 262. | JunB-T-2 | GGGCTGGCGGCGGGCGGGTAG |
| 263. | JunB-T-3 | TCGGGGGCTGGCGCGGGCGGG |
| 264. | JunB-T-4 | TGGGTGCCTGGTCGCGCGTTCTCGGG |
| 265. | JunB-T-5 | AGGGTCCCTGCGGGGCCG |
| 266. | JunB-T-6 | GGGAGGGTCCCTGCGGGG |
| 267. | JunB-T-7 | GGGAGGGTCCCTGCGG |
| 268. | JunB-T-8 | TGGGCCGGGTCCGC |
| 269. | JunB-T-9 | TCCCGGGGGTGTAG |
| 270. | JunB-T-10 | AGTACTGTCCCGGGGGTGT |
| 271. | JunB-T-11 | GGGACACGTTGGGGGGTG |
| 272. | JunB-T-12 | GCCGGGGGGCCCCCGGTAGC |
| 273. | JunB-T-13 | CGGGCCCAGCCGGGGGC |
| 274. | JunB-T-14 | CGGGCCCAGCCGGG |
| 275. | JunB-T-15 | GGGAGGTGGCTCCGGGCCGG |
| 276. | JunB-T-16 | AGGGCGGCGCGTGTGGGA |
| 277. | JunB-T-17 | GGGTGGCCACCGGCGAAGGG |
| 278. | JunB-T-18 | AGGGGCAGGGGACGT |
| 279. | JunB-T-19 | TAAAGGGGCAGGGGACGT |
| 280. | JunB-T-20 | AGGGGGTGTCCGTAAAGGGG |
| 281. | JunD-T-1 | GGGGACGCGAACGTGCCGCCG |
| 282. | JunD-T-2 | CGGGGAACAAGCGGCCCCGGGG |
| 283. | JunD-T-3 | GGCCGTCGGGGGCG |
| 284. | JunD-T-4 | GCGGCCGTCGGGGGGC |
| 285. | JunD-T-5 | AGGGGGGTAGGAGGCGGG |
| 286. | JunD-T-6 | GCGCTGGGGGCGCC |
| 287. | JunD-T-7 | GGCCGTCGGGGGGT |
| 288. | JunD-T-8 | GGGGAGGCCAGCTTC |
| 289. | JunD-T-9 | GGCCGCCACCTTGGGG |
| 290. | JunD-T-10 | GCGGCCGCCGCCGGGG |
| 291. | JunD-T-11 | GGGCGCGGCCGCCCCGCCGGGG |
| 292. | JunD-T-12 | GGGGTGGCGGCGGCGG |
| 293. | JunD-T-13 | GGGGGTGGCGGCGGC |
| 294. | JunD-T-14 | TGGGGCAGCAGCTGGCAG |
| 295. | JunD-T-15 | CGGGGCGCCCACGACACC |
| 296. | JunD-T-16 | CGGGGCGCCCACGACAC |
| 297. | JunD-T-17 | GGGCCGCACCCTCTCCAAGTCCGGGG |
| 298. | ErbB-2-1 | GCAGCAGTCAGTGG |
| 299. | ErbB-2-2 | CCATTGTCTAGCACGG |
| 300. | ErbB-2-3 | GGTCTCCATTGTCTAGC |
| 301. | ErbB-2-4 | GGTGGTATTGTTCAGC |
| 302. | ErbB-2-5 | GCTGGATCAAGACCC |
| 303. | ErbB-2-6 | CCACAAAATCGTGTCC |
| 304. | ErbB-2-7 | CCTTCCACAAAATCGTGTCC |
| 305. | ErbB-2-8 | GGTTGTTCTTGTGG |
| 306. | ErbB-2-9 | CCTCTTGGTTGTGC |
| 307. | ErbB-2-10 | CCAGAGTCTCAAACACTTGG |
| 308. | ErbB-2-11 | GGTAACCTGTGATCTCTTCC |
| 309. | ErbB-2-12 | CCTGCAGTACTCGG |
| 310. | ErbB-2-13 | GGCATTCACATACTCC |
| 311. | ErbB-2-14 | GCAAACAGTGCCTGGC |
| 312. | ErbB-2-15 | CGCATCGTGTACTTCCG |
| 313. | ErbB-2-16 | GCACGTTCCGAGCG |
| 314. | ErbB-2-17 | GGTACCAGATACTCC |
| 315. | ErbB-2-18 | CCAGTGGAGACCTGG |
| 316. | ErbB-2-19 | CCTGAGGACACATCAGG |
| 317. | ErbB-2-20 | CCTCACTTGGTTGTGAGC |
| 318. | ErbB-2-21 | GGAAGATGTCCTTCC |
| 319. | ErbB-2-22 | GCACACTGCTCATGGC |
| 320. | ErbB-2-23 | GCTGTCACCTCTTGG |
| 321. | ErbB-2-24 | CCTCTGCTGTCACC |
| 322. | ErbB-2-25 | CCACACATCACTCTGG |
| 323. | ErbB-2-26 | CCTCCTCTTCAGAGG |

FIG. 3-6

| # | Name | Sequence |
|---|------|----------|
| 324. | ErbB-2-27 | CCTTCTGGTTCACACTGG |
| 325. | ErbB-2-28 | CATGGTGCTCACTGCG |
| 326. | ErbB-2-29 | CTTGGTTGTGAGCG |
| 327. | ErbB-2-30 | GGACAGGCAGTCAC |
| 328. | ErbB-2-31 | GTCACCTCTTGGTTGTGC |
| 329. | ErbB-2-32 | CCAGAGTCTCAAACAC |
| 330. | ErbB-2-33 | CACATACTCCCTGG |
| 331. | ErbB-2-34 | GACCAGCACGTTCCG |
| 332. | ErbB-2-35 | GTTGGTGTCTATCAGTG |
| 333. | ErbB-2-36 | CCCTGGTAGAGGTG |
| 334. | ErbB-2-37 | CTCAAACACTTGGAGC |
| 335. | ErbB-2-38 | CACACATCACTCTGGTGG |
| 336. | ErbB-2-39 | GCACAGACAGTGCGC |
| 337. | ErbB-2-40 | CATGGCAGCAGTCAG |
| 338. | ErbB-2-41 | CTGCTCATGGCAGCAG |
| 339. | ErbB-2-42 | CATCTGGAAACTTCCAGATG |
| 340. | ErbB-2-43 | CTGGAAACTTCCAG |
| 341. | ErbB-2-44 | CATAACTCCACACATCACTC |
| 342. | ErbB-2-45 | CACCATAACTCCACACATC |
| 343. | ErbB-2-46 | CTGGTGGGTGAACC |
| 344. | ErbB-2-47 | CGGATTACTTGCAGG |
| 345. | ErbB-2-48 | CGCTAGGTGTCAGCG |
| 346. | ErbB-2-49 | GCCATCACGTATGC |
| 347. | ErbB-2-50 | GCATACACCAGTTCAGC |
| 348. | ErbB-2-51 | CCATCAAATACATCGG |
| 349. | ErbB-2-52 | CCAGCAGAAGTCAGG |
| 350. | ErbB-2-53 | GCTTCATGTCTGTGC |
| 351. | ErbB-2-54 | GGTGAGTTCCAGGTTTCC |
| 352. | ErbB-2-55 | CCACAAAATCGTGTCCTGG |
| 353. | ErbB-2-56 | CCCTTACACATCGG |
| 354. | ErbB-2-57 | GCAGCTCACAGATGC |
| 355. | ErbB-2-58 | GCACTGGTAACTGC |
| 356. | ErbB-2-59 | CCTGCATATTGGCACTGG |
| 357. | ErbB-2-60 | CCAGCAAACTCCTGG |
| 358. | ErbB-2-61 | GCAGAAATGCCAGGC |
| 359. | ErbB-2-62 | CCATTGTGCAGAATTCG |
| 360. | ErbB-2-63 | CCCTGCAGTACTCGG |
| 361. | ErbB-2-64 | GGCATTCACATACTCCC |
| 362. | ErbB-2-65 | GGTCAGGTTTCACACC |
| 363. | ErbB-2-66 | CCAGGTCCACACAGG |
| 364. | ErbB-2-67 | CCTTGTCATCCAGG |
| 365. | ErbB-2-68 | GGATCCCAAAGACC |
| 366. | ErbB-2-69 | CCTCAACACTTTGATGG |
| 367. | ErbB-2-70 | GCTGTGTCACCAGC |
| 368. | ErbB-2-71 | GGTCTAAGAGGCAGCC |
| 369. | ErbB-2-72 | GGCAATCTGCATACACC |
| 370. | ErbB-2-73 | CCTGTGTACGAGCC |
| 371. | ErbB-2-74 | CCATCCACTTGATGG |
| 372. | ErbB-2-75 | CCCACACAGTCACACC |
| 373. | ErbB-2-76 | CCATCGTAAGGTTTGG |
| 374. | ErbB-2-77 | CCTTTTCCAGCAGG |
| 375. | ErbB-2-78 | GGAGAATTCAGACACC |
| 376. | ErbB-2-79 | CCAAGTCCTCATTCTGG |
| 377. | ErbB-2-80 | CCATCAGTCTCAGAGG |
| 378. | ErbB-2-81 | CCTTTGAAGGTGCTGG |
| 379. | ErbB-2-82 | GGCATGGCAGGTTCC |
| 380. | ErbB-2-83 | CCTGGCATGGCAGG |
| 381. | ErbB-2-N-1 | AGATGTATAGGTAA |
| 382. | ErbB-2-N-2 | ATTTTCACATTCTC |
| 383. | ErbB-2-N-3 | AATTTTCACATTCTC |
| 384. | ErbB-2-N-4 | AATTTTCACATTCT |
| 385. | ErbB-2-N-5 | GAATTTTCACATTC |
| 386. | ErbB-2-N-6 | GGAATTTTCACATT |
| 387. | ErbB-2-N-7 | AGATTTCTTTGTTG |
| 388. | ErbB-2-N-8 | AAGATTTCTTTGTTG |
| 389. | ErbB-2-N-9 | AAGATTTCTTTGTT |

FIG. 3-7

| # | Name | Sequence |
|---|---|---|
| 390. | ErbB-2-N-10 | TAAGATTTCTTTGTT |
| 391. | ErbB-2-N-11 | CTAAGATTTCTTTGTT |
| 392. | ErbB-2-N-12 | TAAGATTTCTTTGT |
| 393. | ErbB-2-N-13 | CTAAGATTTCTTTGT |
| 394. | ErbB-2-N-14 | CTAAGATTTCTTTG |
| 395. | ErbB-2-N-15 | TCTAAGATTTCTTT |
| 396. | ErbB-2-N-16 | GTCTAAGATTTCTTT |
| 397. | ErbB-2-N-17 | GTCTAAGATTTCTT |
| 398. | ErbB-2-N-18 | TTCGTCTAAGATTT |
| 399. | ErbB-2-N-19 | ATTTTGACATGGTT |
| 400. | ErbB-2-N-20 | AATTTTGACATGGTT |
| 401. | ErbB-2-N-21 | AATTTTGACATGGT |
| 402. | ErbB-2-N-22 | TAATTTTGACATGGT |
| 403. | ErbB-2-N-23 | TAATTTTGACATGG |
| 404. | ErbB-2-N-24 | GTAATTTTGACATG |
| 405. | ErbB-2-N-25 | TGTAATTTTGACATG |
| 406. | ErbB-2-N-26 | TGTAATTTTGACAT |
| 407. | ErbB-2-N-27 | TCTGTAATTTTGACAT |
| 408. | ErbB-2-N-28 | CTGTAATTTTGACA |
| 409. | ErbB-2-N-29 | TCTGTAATTTTGACA |
| 410. | ErbB-2-N-30 | TCTGTAATTTTGAC |
| 411. | ErbB-2-N-31 | GTCTGTAATTTTGA |
| 412. | ErbB-2-N-32 | AAGTCTGTAATTTTGA |
| 413. | ErbB-2-N-33 | AGTCTGTAATTTTG |
| 414. | ErbB-2-N-34 | AAGTCTGTAATTTTG |
| 415. | ErbB-2-N-35 | AAGTCTGTAATTTT |
| 416. | ErbB-2-N-36 | GAAGTCTGTAATTTT |
| 417. | ErbB-2-N-37 | GAAGTCTGTAATTT |
| 418. | ErbB-2-N-38 | ATGTAGACATCAAT |
| 419. | ErbB-2-N-39 | ATCATCCAACATTT |
| 420. | ErbB-2-N-40 | AATCATCCAACATTT |
| 421. | ErbB-2-N-41 | AATCATCCAACATT |
| 422. | ErbB-2-N-42 | ACCATCAAATACAT |
| 423. | ErbB-2-N-43 | AAAAACGTCTTTGA |
| 424. | ErbB-2-N-44 | TTTTGTTCTTAGACA |
| 425. | ErbB-2-N-45 | TTTTGTTCTTAGAC |
| 426. | ErbB-2-N-46 | TAAACAGAAAAGCA |
| 427. | ErbB-2-N-47 | ACTAAACAGAAAAG |
| 428. | ErbB-2-N-48 | AAACTAAACAGAAAAG |
| 429. | ErbB-2-N-49 | AACTAAACAGAAAA |
| 430. | ErbB-2-N-50 | AAACTAAACAGAAAA |
| 431. | ErbB-2-N-51 | AAACTAAACAGAAA |
| 432. | ErbB-2-N-52 | TAAAAACTAAACAGAAA |
| 433. | ErbB-2-N-53 | AAAACTAAACAGAA |
| 434. | ErbB-2-N-54 | GTAAAAACTAAACAGAA |
| 435. | ErbB-2-N-55 | AAAAACTAAACAGA |
| 436. | ErbB-2-N-56 | TAAAAACTAAACAGA |
| 437. | ErbB-2-N-57 | TAAAAACTAAACAG |
| 438. | ErbB-2-N-58 | GTAAAAACTAAACA |
| 439. | ErbB-2-N-59 | AAAAAGTAAAAACTAAACA |
| 440. | ErbB-2-N-60 | AGTAAAAACTAAAC |
| 441. | ErbB-2-N-61 | AAAAAAGTAAAAACTAAAC |
| 442. | ErbB-2-N-62 | AAGTAAAAACTAAA |
| 443. | ErbB-2-N-63 | AAAAAAAGTAAAAACTAAA |
| 444. | ErbB-2-N-64 | AAAGTAAAAACTAA |
| 445. | ErbB-2-N-65 | AAAAGTAAAAACTA |
| 446. | ErbB-2-N-66 | AAAAAAAGTAAAAACTA |
| 447. | ErbB-2-N-67 | AAAAAGTAAAAACT |
| 448. | ErbB-2-N-68 | AAAAAAAGTAAAAACT |
| 449. | ErbB-2-N-69 | AAAAAAAGTAAAAAC |
| 450. | ErbB-2-N-70 | CAAAAAAAGTAAAAAC |
| 451. | ErbB-2-N-71 | AAAAAAAAGTAAAAA |
| 452. | ErbB-2-N-72 | CAAAAAAAGTAAAA |
| 453. | ErbB-2-N-73 | AACAAAACAAAAAAAGTAAA |
| 454. | ErbB-2-N-74 | AAACAAAAAAAGTA |
| 455. | ErbB-2-N-75 | CAAAACAAAAAAAGTA |
| 456. | ErbB-2-N-76 | CAAAACAAAAAAAGT |

FIG. 3-8

| | | |
|---|---|---|
| 457. | ErbB-2-77 | CAAAACAAAAAAAG |
| 458. | ErbB-2-78 | CTTTAAAAAAACAAAAC |
| 459. | ErbB-2-79 | TCTTTAAAAAAACAAA |
| 460. | ErbB-2-80 | GTCTTTAAAAAAACAAA |
| 461. | ErbB-2-81 | GTCTTTAAAAAAACA |
| 462. | ErbB-2-82 | GTCTTTAAAAAAAC |
| 463. | ErbB-2-83 | TTTATTTCGTCTTT |
| 464. | ErbB-2-84 | TCTTTATTTCGTCT |
| 465. | ErbB-2-85 | TATTTGCAAATGGA |
| 466. | ErbB-2-86 | TATATTTGCAAATGG |
| 467. | ErbB-2-87 | TATATTTGCAAATG |
| 468. | ErbB-2-88 | CAAAATATATTTGCAAATG |
| 469. | ErbB-2-89 | CAAAATATATTTGCAAAT |
| 470. | ErbB-2-90 | CAAAATATATTTGCA |
| 471. | ErbB-2-91 | CAAAATATATTTGC |
| 472. | ErbB-2-92 | TTCCAAAATATATTG |
| 473. | ErbB-2-93 | TTTTCCAAAATATATTT |
| 474. | ErbB-2-94 | GTTTTCCAAAATATATT |
| 475. | ErbB-2-95 | GTTTTCCAAAATAT |
| 476. | c-fos-1 | GGTTAGGCAAAGCC |
| 477. | c-fos-2 | CCGAGAACATCATCGTGG |
| 478. | c-fos-3 | CCGAGAACATCATCGTG |
| 479. | c-fos-4 | CCGAGAACATCATCG |
| 480. | c-fos-5 | CGTAGTCTGCGTTGAAGC |
| 481. | c-fos-6 | CCATGCTGGAGAAGG |
| 482. | c-fos-7 | CCGTGCAGAAGTCC |
| 483. | c-fos-8 | GGAATGAAGTTGGC |
| 484. | c-fos-9 | TGACCGTGGGAATG |
| 485. | c-fos-10 | TGGCAGTGACCGTG |
| 486. | c-fos-11 | AGATGGCAGTGACC |
| 487. | c-fos-12 | CGAGATGGCAGTGACC |
| 488. | c-fos-13 | CCAGCCACTGCAGG |
| 489. | c-fos-14 | GCACCAGCCACTGC |
| 490. | c-fos-15 | CCCTGGAGTAAGCC |
| 491. | c-fos-16 | GGAGATAACTGTTCCACC |
| 492. | c-fos-17 | GGAGATAACTGTTCC |
| 493. | c-fos-18 | CTTCTAGTTGGTCTG |
| 494. | c-fos-19 | CATCTTCTAGTTGG |
| 495. | c-fos-20 | TCTCATCTTCTAGTTGG |
| 496. | c-fos-21 | CTGCAAAGCAGACTTCTC |
| 497. | c-fos-22 | CCTTCAGCAGGTTGG |
| 498. | c-fos-23 | CCCAGGTCATCAGG |
| 499. | c-fos-24 | CCAGTCAGATCAAGG |
| 500. | c-fos-25 | GGTGAAGGCCTCCTC |
| 501. | c-fos-26 | CAGGGTGAAGGCCTC |
| 502. | c-fos-27 | CCTGGATGATGCTGG |
| 503. | c-fos-28 | CCACTGTGCAGAGG |
| 504. | c-fos-29 | GGAGTACAGGTGACC |
| 505. | c-fos-30 | GCTCATTGCTGCTGC |
| 506. | c-fos-31 | GGAAGGCTCATTGCTGC |
| 507. | c-fos-N-1 | TTTTCTCTTCTTCT |
| 508. | c-fos-N-2 | ATCTTATTCCTTTC |
| 509. | c-fos-N-3 | CATCTTATTCCTTT |
| 510. | c-fos-N-4 | TAGTTTTTCCTTCT |
| 511. | c-fos-N-5 | TCTAGTTTTTCCTT |
| 512. | c-fos-N-6 | AACTCTAGTTTTTC |
| 513. | c-fos-N-7 | GAACTCTAGTTTTT |
| 514. | c-fos-N-8 | TGAACTCTAGTTTTT |
| 515. | c-fos-N-9 | ATGAACTCTAGTTTTT |
| 516. | c-fos-N-10 | TGAACTCTAGTTTT |
| 517. | c-fos-N-11 | ATGAACTCTAGTTTT |
| 518. | c-fos-N-12 | ATGAACTCTAGTTT |
| 519. | TGF-B2-1 | GCACACAGTAGTGC |

FIG. 3-9

| | | |
|---|---|---|
| 520. | TGF-B2-2 | GCAGGATCAGAAAAGC |
| 521. | TGF-B2-3 | GCAGGTAGACAGGC |
| 522. | TGF-B2-4 | GCTTGCTCAGGATCTGC |
| 523. | TGF-B2-5 | GCAAGTCCCTGGTGC |
| 524. | TGF-B2-6 | CCTGGAGCAAGTCC |
| 525. | TGF-B2-7 | CGTAGTACTCTTCGTCG |
| 526. | TGF-B2-8 | CGTAGTACTCTTCG |
| 527. | TGF-B2-9 | GTAAACCTCCTTGG |
| 528. | TGF-B2-10 | GTCTATTTTGTAAACCTCC |
| 529. | TGF-B2-11 | GCATGTCTATTTTGTAAACC |
| 530. | TGF-B2-12 | GGCATCAAGGTACCC |
| 531. | TGF-B2-13 | GGCATCAAGGTACC |
| 532. | TGF-B2-14 | GCTTTCACCAAATTGGAAGC |
| 533. | TGF-B2-15 | GAGAATCTGATATAGCTC |
| 534. | TGF-B2-16 | GGAGATGTTAAATCTTTGG |
| 535. | TGF-B2-17 | GCTGTCGATGTAGC |
| 536. | TGF-B2-18 | CCAGGTTCCTGTCTTTATGG |
| 537. | TGF-B2-19 | CAGCAGGGACAGTG |
| 538. | TGF-B2-20 | CTTGCTTCTAGTTCTTCAC |
| 539. | TGF-B2-21 | GCCATCAATACCTGC |
| 540. | TGF-B2-22 | GGTGCCATCAATACC |
| 541. | TGF-B2-23 | CCACTGGTATATGTGG |
| 542. | TGF-B2-24 | GGACTTTATAGTTTTCTG |
| 543. | TGF-B2-25 | CTCAAGTCTGTAGGAG |
| 544. | TGF-B2-26 | GGTCTGTTGTGACTC |
| 545. | TGF-B2-27 | CAATTATCCTGCACATTTC |
| 546. | TGF-B2-28 | GCAGCAATTATCCTGC |
| 547. | TGF-B2-29 | GGCAGCAATTATCC |
| 548. | TGF-B2-30 | GGTTCGTGTATCCATTTCC |
| 549. | TGF-B2-31 | GCACAGAAGTTGGC |
| 550. | TGF-B2-32 | CCAGCACAGAAGTTGG |
| 551. | TGF-B2-33 | GTGCTGAGTGTCTG |
| 552. | TGF-B2-34 | CCTGCTGTGCTGAGTG |
| 553. | TGF-B2-35 | GCTCAGGACCCTGC |
| 554. | TGF-B2-36 | GCAGCAAGGGAAGC |
| 555. | TGF-B2-37 | CCAATGTAGTAGAGAATGG |
| 556. | TGF-B2-38 | GCTGCATTTGCAAG |
| 557. | TGF-B2-N-1 | AAAAAAGAAATCAA |
| 558. | TGF-B2-N-2 | AAAAAAAGAAATCAA |
| 559. | TGF-B2-N-3 | AAAAAAAAGAAATCAA |
| 560. | TGF-B2-N-4 | TAAAAAAAAGAAATCAA |
| 561. | TGF-B2-N-5 | ATAAAAAAAAGAAATCAA |
| 562. | TGF-B2-N-6 | AATAAAAAAAAGAAATCAA |
| 563. | TGF-B2-N-7 | GAATAAAAAAAAGAAAT |
| 564. | TGF-B2-N-8 | AGAATAAAAAAAAGAAAT |
| 565. | TGF-B2-N-9 | CAGAATAAAAAAAA |
| 566. | TGF-B2-N-10 | TCAGAATAAAAAAAA |
| 567. | TGF-B2-N-11 | TTGTTTTTAAAAGT |
| 568. | TGF-B2-N-12 | AGTTGTTTTTAAAA |
| 569. | TGF-B2-N-13 | AAGTTGTTTTTAAAA |
| 570. | TGF-B2-N-14 | AAAGTTGTTTTTAAAA |
| 571. | TGF-B2-N-15 | AAAAGTTGTTTTTAAAA |
| 572. | TGF-B2-N-16 | AAAAAGTTGTTTTTAAAA |
| 573. | TGF-B2-N-17 | AAAAAAGTTGTTTTTAAAA |
| 574. | TGF-B2-N-18 | AAAAAAAGTTGTTTTTAAAA |
| 575. | TGF-B2-N-19 | AAAAAAAAGTTGTTTTTAA |
| 576. | TGF-B2-N-20 | TTTTTAAAAAAGTG |
| 577. | TGF-B2-N-21 | TTTTTTAAAAAAGTG |
| 578. | TGF-B2-N-22 | ATTTTTTAAAAAAGTG |
| 579. | TGF-B2-N-23 | CATTTTTTAAAAAAGT |
| 580. | TGF-B2-N-24 | GCATTTTTTAAAAAA |
| 581. | TGF-B2-N-25 | TGCATTTTTTAAAAAA |
| 582. | TGF-B2-N-26 | AGCTTATTTTAAAT |
| 583. | TGF-B2-N-27 | AAGCTTATTTTAAAT |
| 584. | TGF-B2-N-28 | TAAGCTTATTTTAAAT |
| 585. | TGF-B2-N-29 | TGTAATTATTAGAT |

FIG. 3-10

| | | |
|---|---|---|
| 586. | TGF-B2-N-30 | ATGTAATTATTAGAT |
| 587. | TGF-B2-N-31 | TGATGTAATTATTA |
| 588. | TGF-B2-N-32 | ATGATGTAATTATTA |
| 589. | TGF-B2-N-33 | ATGGTATTATATAA |
| 590. | TGF-B2-N-34 | TATGGTATTATATAA |
| 591. | TGF-B2-N-35 | TTATGGTATTATATAA |
| 592. | TGF-B2-N-36 | TTTATGGTATTATATAA |
| 593. | TGF-B2-N-37 | ATTTATGGTATTATATAA |
| 594. | TGF-B2-N-38 | AATCATATTAGAAA |
| 595. | TGF-B2-N-39 | TTACAATCATATTA |
| 596. | TGF-B2-N-40 | TTTACAATCATATTA |
| 597. | rb-1 | GGCATGACGCCTTTCC |
| 598. | rb-2 | GCATGACGCCTTTC |
| 599. | rb-3 | GCCTGACGAGAGGC |
| 600. | rb-4 | CTCAAGCCTGACGAG |
| 601. | rb-5 | CCACAGTTCCTTTTC |
| 602. | rb-6 | GCTGCAATAAAGATACAG |
| 603. | rb-7 | GCTGCAATAAAGATAC |
| 604. | rb-8 | GGACACTGATTTCTATG |
| 605. | rb-9 | GCATTATCAACTTTGG |
| 606. | rb-10 | ACTTTTAGCACCAATG |
| 607. | rb-11 | CCAAGAAACTTTTAGCACC |
| 608. | rb-12 | CCAGATCATCTTCC |
| 609. | rb-13 | AGTCAAGGACACATAG |
| 610. | rb-14 | TCTTTGAGCAACATGG |
| 611. | rb-15 | GGGTATAACAGCTG |
| 612. | rb-16 | GAGGTGAACCATTAATGG |
| 613. | rb-17 | TCTTCGTATCGTTTAG |
| 614. | rb-18 | TGTTGGATAGTGTTC |
| 615. | rb-19 | GTTGATCACTTGCTG |
| 616. | rb-20 | GGATTCCATTACTCG |
| 617. | rb-21 | GACATATGAAAAATGTTGTC |
| 618. | rb-22 | GCCAATAAAGACATATG |
| 619. | rb-23 | CCAGAATCAAGATTCTG |
| 620. | rb-24 | CTGTTCCAGAATCAAG |
| 621. | rb-25 | GACAAATCTGTTCCAGAATC |
| 622. | rb-26 | GGAAAGACAAATCTGTTCC |
| 623. | rb-27 | GATTAAGAGGACAAGC |
| 624. | rb-28 | GGAAGATTAAGAGG |
| 625. | rb-29 | GCAGTGTGATTATTCTGG |
| 626. | rb-30 | GGAGAAAGATACATATCTG |
| 627. | rb-31 | GGAGATCTTACAGG |
| 628. | rb-32 | GCATTTGCAGTAGAATTTAC |
| 629. | rb-33 | CAGTGAAAGAGAGG |
| 630. | rb-34 | GCTAGCCGATACAC |
| 631. | rb-35 | GGAAGATCCTTGTATGC |
| 632. | rb-36 | GCATGAGGAAGATCC |
| 633. | rb-37 | GGAGTCATTTTTGTTG |
| 634. | rb-38 | CCAATTGATACTAAGATTC |
| 635. | rb-39 | TCTTTTGAGCCACACG |
| 636. | rb-40 | CCTTCAGCACTTCTTTTG |
| 637. | rb-41 | GGTTGCTTCCTTCAGC |
| 638. | rb-42 | CAGTGGTTTAGGAG |
| 639. | rb-43 | CCTGAGATCCTCATTTC |
| 640. | rb-44 | CCAAGGTCCTGAGATCC |
| 641. | rb-45 | GGTGTACACAGTGTCC |
| 642. | rb-N-1 | TATCTTTAATTTCT |
| 643. | rb-N-2 | TCTTTTGAATATAA |
| 644. | rb-N-3 | TTCTTTTGAATATAA |
| 645. | rb-N-4 | TTTCTTTTGAATATAA |
| 646. | rb-N-5 | TTTTCTTTTGAATATAA |
| 647. | rb-N-6 | TTTTTCTTTTGAATATAA |
| 648. | rb-N-7 | ATTTCTATGTTTTT |
| 649. | rb-N-8 | TTAAAGAATTTATG |
| 650. | rb-N-9 | GTTAAAGAATTTAT |

FIG. 3-11

| | | |
|---|---|---|
| 651. | rb-N-10 | AGTTAAAGAATTTAT |
| 652. | rb-N-11 | AAGTTAAAGAATTTAT |
| 653. | rb-N-12 | TAAGTTAAAGAATTTAT |
| 654. | rb-N-13 | TTTAGTAAGTTAAA |
| 655. | rb-N-14 | TTTTAGTAAGTTAAA |
| 656. | rb-N-15 | ATTTCTTTTAGTAA |
| 657. | rb-N-16 | AATTTCTTTTAGTAA |
| 658. | rb-N-17 | ATCAATTTCTTTTA |
| 659. | rb-N-18 | TATCAATTTCTTTTA |
| 660. | rb-N-19 | AATATATAAGTTCA |
| 661. | rb-N-20 | AAATATATAAGTTCA |
| 662. | rb-N-21 | CAAATATATAAGTT |
| 663. | rb-N-22 | TCAAATATATAAGTT |
| 664. | rb-N-23 | TGTCAAATATATAA |
| 665. | rb-N-24 | AATTTATTTCAGTA |
| 666. | rb-N-25 | AATAAAAATGTGAT |
| 667. | rb-N-26 | TAATAAAAATGTGAT |
| 668. | rb-N-27 | TAGCTAATAAAAAT |
| 669. | rb-N-28 | TTAGCTAATAAAAAT |
| 670. | rb-N-29 | TTTAGCTAATAAAAAT |
| 671. | rb-N-30 | AATAAAATAGTCAA |
| 672. | rb-N-31 | TAATAAAATAGTCAA |
| 673. | rb-N-32 | TTAATAAAATAGTCAA |
| 674. | rb-N-33 | TTTAATAAAATAGTCAA |
| 675. | rb-N-34 | GTTTAATAAAATAGT |
| 676. | rb-N-35 | AGTTTAATAAAATAGT |
| 677. | rb-N-36 | GAGTTTAATAAAATA |
| 678. | rb-N-37 | AGAGTTTAATAAAATA |
| 679. | rb-N-38 | AATAATTCTTGTAT |
| 680. | rb-N-39 | TATATTACATTCAT |
| 681. | rb-N-40 | ATCTATATTACATT |
| 682. | rb-N-41 | ATAAACATTTTTCA |
| 683. | rb-N-42 | AATAAACATTTTTCA |
| 684. | rb-N-43 | AAATAAACATTTTTCA |
| 685. | rb-N-44 | GAAATAAACATTTTT |
| 686. | rb-N-45 | TGAAATAAACATTTTT |
| 687. | rb-N-46 | TTGAAATAAACATTTTT |
| 688. | rb-N-47 | TTTGAAATAAACATTTTT |
| 689. | rb-N-48 | TTTTGAAATAAACATTTTT |
| 690. | rb-N-49 | TTTTTGAAATAAACATTTT |
| 691. | rb-N-50 | ATTTTTGAAATAAACATTTT |
| 692. | rb-N-51 | AATTTTTGAAATAAACATT |
| 693. | rb-N-52 | AAATTTTTGAAATAAACATT |
| 694. | rb-N-53 | AAAATTTTTGAAATAAACAT |
| 695. | rb-N-54 | TAAAATTTTTGAAATAAACA |
| 696. | rb-N-55 | ATAAAATTTTTGAAATAAAC |
| 697. | rb-N-56 | TATAAAATTTTTGAAATAAA |
| 698. | rb-N-57 | GTATAAAATTTTTGAAAT |
| 699. | rb-N-58 | GGTATAAAATTTTT |
| 700. | rb-N-59 | AGGTATAAAATTTTT |
| 701. | rb-N-60 | AAGGTATAAAATTTTT |
| 702. | rb-N-61 | AAAGGTATAAAATTTTT |
| 703. | rb-N-62 | AAAAGGTATAAAATTTTT |
| 704. | rb-N-63 | TAAAAGGTATAAAATTTTT |
| 705. | rb-N-64 | ATAAAAGGTATAAAATTTTT |
| 706. | rb-N-65 | TTTAGAAAGATTTT |
| 707. | rb-N-66 | AAGATAAATTTCTT |
| 708. | rb-N-67 | TAAGATAAATTTCTT |
| 709. | rb-N-68 | TTAAGATAAATTTCTT |
| 710. | rb-N-69 | TTTAAGATAAATTTCTT |
| 711. | rb-N-70 | TTTTAAGATAAATTTCTT |
| 712. | rb-N-71 | TTTTTAAGATAAATTTCTT |
| 713. | rb-N-72 | ATTTTTAAGATAAATTTCTT |
| 714. | rb-N-73 | TATTTTTAAGATAAATTTCT |
| 715. | rb-N-74 | TTATTTTTAAGATAAATT |
| 716. | rb-N-75 | TTTATTTTTAAGATAAATT |
| 717. | rb-N-76 | CTTTATTTTTAAGATAAAT |

FIG. 3-12

| # | Name | Sequence |
|---|---|---|
| 718. | rb-N-77 | TCTTTATTTTTAAGATAAAT |
| 719. | rb-N-78 | ATCTTTATTTTTAAGATAAA |
| 720. | rb-N-79 | ATCTTTATTTTTAA |
| 721. | rb-N-80 | GATCTTTATTTTTAA |
| 722. | rb-N-81 | AGATCTTTATTTTTAA |
| 723. | rb-N-82 | TAGATCTTTATTTTTAA |
| 724. | rb-N-83 | AATCATCATTAATT |
| 725. | rb-N-84 | AAATCATCATTAATT |
| 726. | rb-N-85 | AAAATCATCATTAATT |
| 727. | rb-N-86 | TAAAATCATCATTAATT |
| 728. | rb-N-87 | TTAAAATCATCATTAATT |
| 729. | rb-N-88 | TTTAAAATCATCATTAATT |
| 730. | rb-N-89 | ATTTAAAATCATCATTAATT |
| 731. | rb-N-90 | AATTTAAAATCATCATTAA |
| 732. | rb-N-91 | GAATTTAAAATCAT |
| 733. | rb-N-92 | TGAATTTAAAATCAT |
| 734. | rb-N-93 | TTAAAATAGGAAAT |
| 735. | rb-N-94 | AATTTCTCTTTAAA |
| 736. | rb-N-95 | AAATTTCTCTTTAAA |
| 737. | rb-N-96 | TAAAATTTTGAATG |
| 738. | rb-N-97 | CTAAAATTTTGAAT |
| 739. | rb-N-98 | TTTGCTAAAATTTT |
| 740. | rb-N-99 | ATATGAAAAATGTT |
| 741. | rb-N-100 | TTTTAAATTAAGCA |
| 742. | rb-N-101 | TTGTAAAAATCAAA |
| 743. | rb-N-102 | TTTGTAAAAATCAAA |
| 744. | rb-N-103 | TTTGATAAAACTTT |
| 745. | rb-N-104 | ATGTTTTATCATTT |
| 746. | rb-N-105 | AATGTTTTATCATTT |
| 747. | rb-N-106 | AAATGTTTTATCATTT |
| 748. | rb-N-107 | TAAATGTTTTATCATTT |
| 749. | rb-N-108 | TCTAAATGTTTTAT |
| 750. | rb-N-109 | TTCTAAATGTTTTAT |
| 751. | rb-N-110 | TAAGATCAAATAAA |
| 752. | rb-N-111 | ATAAGATCAAATAAA |
| 753. | rb-N-112 | AATAAGATCAAATAAA |
| 754. | rb-N-113 | TAATAAGATCAAATAAA |
| 755. | rb-N-114 | TTAATAAGATCAAATAAA |
| 756. | rb-N-115 | TTTAATAAGATCAAATAAA |
| 757. | rb-N-116 | TTGTTTAATAAGAT |
| 758. | rb-N-117 | ATTGTTTAATAAGAT |
| 759. | rb-N-118 | TGATTGTTTAATAA |
| 760. | rb-N-119 | TTGATTGTTTAATAA |
| 761. | rb-N-120 | TTTGATTGTTTAATAA |
| 762. | rb-N-121 | TTTTATAAAACAGT |
| 763. | rb-N-122 | TTTTTATAAAACAGT |
| 764. | rb-N-123 | TTTTTTATAAAACAGT |
| 765. | rb-N-124 | CTTTTTTATAAAACA |
| 766. | rb-N-125 | ACTTTTTTATAAAACA |
| 767. | rb-N-126 | CACTTTTTTATAAAA |
| 768. | rb-N-127 | ACACTTTTTTATAAAA |
| 769. | rb-N-128 | TACACTTTTTTATAAAA |
| 770. | rb-N-129 | ATACACTTTTTTATAAAA |
| 771. | rb-N-130 | ATTTTGAATTTAAG |
| 772. | rb-N-131 | GATTTTGAATTTAA |
| 773. | rb-N-132 | TGATTTTGAATTTAA |
| 774. | rb-N-133 | ATGATTTTGAATTTAA |
| 775. | rb-N-134 | AATGATTTTGAATTTAA |
| 776. | rb-N-135 | ATAATAGAATCATA |
| 777. | rb-N-136 | TATAATAGAATCATA |
| 778. | rb-N-137 | TATAATAGAATCAT |
| 779. | rb-N-138 | TACTATAATAGAAT |
| 780. | rb-N-139 | ATACTATAATAGAAT |
| 781. | rb-N-140 | AATACTATAATAGAAT |
| 782. | rb-N-141 | AGAATACTATAATA |
| 783. | rb-N-142 | TAGAATACTATAATA |
| 784. | rb-N-143 | ATAGAATACTATAATA |

FIG. 3-13

| | | |
|---|---|---|
| 785. | rb-N-144 | TATAGAATACTATAATA |
| 786. | rb-N-145 | TTATAGAATACTATAATA |
| 787. | rb-N-146 | AATATTTGTTTTCA |
| 788. | rb-N-147 | AAATATTTGTTTTCA |
| 789. | rb-N-148 | AAAATATTTGTTTCA |
| 790. | rb-N-149 | CAAAATATTTGTTTT |
| 791. | rb-N-150 | AAATTTTATATGGA |
| 792. | rb-N-151 | TGAAATTTTATATG |
| 793. | rb-N-152 | CTGAAATTTTATAT |
| 794. | rb-N-153 | TCTGAAATTTTATAT |
| 795. | rb-N-154 | TTCTGAAATTTTATAT |
| 796. | rb-N-155 | ATCTGATTTATTTT |
| 797. | rb-N-156 | AAGATATTAAATGT |
| 798. | rb-N-157 | TGAAGATATTAAAT |
| 799. | rb-N-158 | ATAAATAACAATGA |
| 800. | rb-N-159 | TATAAATAACAATGA |
| 801. | rb-N-160 | GTATAAATAACAAT |
| 802. | rb-N-161 | TGTATAAATAACAAT |
| 803. | rb-N-162 | TTGTATAAATAACAAT |
| 804. | rb-N-163 | TCTTGTATAAATAA |
| 805. | rb-N-164 | ATCTTGTATAAATAA |
| 806. | rb-N-165 | ATTCTTGTATAAATAA |
| 807. | rb-N-166 | ACAACTTTTTAAAAT |
| 808. | rb-N-167 | TACAACTTTTTAAAT |
| 809. | rb-N-168 | TACAACTTTTTAAA |
| 810. | rb-T-1 | CGGGGGGTTTTGGGCGGCATG |
| 811. | rb-T-2 | TTTTCGGGGGGTTTTGGGCGGCA |
| 812. | rb-T-3 | TCGGGGGGTTTTGGGCGGC |
| 813. | rb-T-4 | GGTGGCGGCCGTTTTTCGGGGGGT |
| 814. | rb-T-5 | CCGGGGGTTCCGCGGCGGCAGCG |
| 815. | rb-T-6 | CGGGGGTTCCGCGGCGG |
| 816. | rb-T-7 | GGCGGGCGGTGCCGGGCGTTCCGC |
| 817. | rb-T-8 | GGAGGGGGCGGCGGCGGCGGTG |
| 818. | rb-T-9 | GGGGGCGGCGGCGGCGG |
| 819. | rb-T-10 | GGGGCGGCGGCGGCCG |
| 820. | rb-T-11 | AGGGGGCCTGGTGGAAG |
| 821. | rb-T-12 | TAGGGGGCCTGGTG |
| 822. | rb-T-13 | GTAGGGGGCCTGGT |
| 823. | rb-T-14 | GAGGTATTGGTGACAAGGTAGGGGGC |
| 824. | rb-T-15 | TCTTCAGGGGTGAAATATAGATGTTC |
| 825. | rb-T-16 | GGACTCTTCAGGGGTG |

FIG. 4-1

| | |
|---|---|
| 826 | TCGGACTATA CTGC |
| 827 | CAGTTCGGAC TATACT |
| 828 | AAGCCTAAGA CGCA |
| 829 | GCCCAAGTTC AACA |
| 830 | TGAAAAGTCG CGGT |
| 831 | GGTTAATTAA GATGCCTC |
| 832 | TCTCTAAGAG CGCA |
| 833 | ACGTGAGGTT AGTTG |
| 834 | CACGTGAGGT TAGT |
| 835 | CATAGAACAG TCCG |
| 836 | CAGTCATAGA ACAGTC |
| 837 | CTTTGCAGTC ATAGAACA |
| 838 | TGCAGTCATA GAAC |
| 839 | GGTCGTTTCC ATCT |
| 840 | CATAGAAGGT CGTTTC |
| 841 | CGTCATAGAA GGTC |
| 842 | CATCGTCATA GAAGG |
| 843 | GGACGGCAGG AACGAGGCGT TGAG |
| 844 | TAGCCATAAG GTCC |
| 845 | GGTTACTGTA GCCA |
| 846 | GGTTACTGTA GCCA |
| 847 | AGTTCTTGGC GCGGAGGT |
| 848 | AGGTGAGGAG GTCCGAGT |
| 849 | TGGACTGGAT TATCAG |
| 850 | GTGGTGGTGA TGTGCCCG |
| 851 | TGTCACGTTC TTGG |
| 852 | CTCATCTGTC ACGT |
| 853 | CGAAGCCCTC GGCGAACC |
| 854 | GCGTGTTCTG GCTGTGCAGT TCGG |
| 855 | CTGCCCCGTT GACC |
| 856 | AGGTTTGCGT AGAC |
| 857 | GGTTGAAGTT GCTG |
| 858 | CTGGGTTGAA GTTG |
| 859 | TGCTGCACGG GCATCTGCTG |
| 860 | GGCACTGTCT GAGGCTCCTC CTTCAGG |
| 861 | ACTCCATGTC GATG |
| 862 | CTCTCCGCCT TGATCC |
| 863 | GTTCCTCATG CGTTC |
| 864 | CTGAGCTTTC AAGG |
| 865 | GCGATTCTCT CCAGCTTCCT TTTTCG |
| 866 | CTGAGCTTTC AAGGTTTTCA CTTTTTCCTC |
| 867 | TCCCTGAGCA TGTT |
| 868 | TCTGTTTAAG CTGTGC |
| 869 | CTTTCTGTTT AAGCTGTG |
| 870 | GGTTCATGAC TTTCTG |
| 871 | CGTGGTTCAT GACT |
| 872 | ACTGTTAACG TGGTTC |
| 873 | CCACTGTTAA CGTG |
| 874 | CCCACTGTTA ACGT |
| 875 | AGCATGAGTT GGCA |
| 876 | GCGTTAGCAT GAGT |
| 877 | GTTTGCAACT GCTG |
| 878 | CAAAATGTTT GCAACTGC |

FIG. 4-2

| | |
|---|---|
| 879 | TCCATTTTAG TGCACATC |
| 880 | CTGTTCCATT TTAGTGCA |
| 881 | GTGTATGAGT CGTC |
| 882 | CTGTGTATGA GTCG |
| 883 | CGTAGCTGTG TATG |
| 884 | TCGTGTAGAG AGAG |
| 885 | AGTTTGTAGT CGTGTAGA |
| 886 | GTTTGTAGTC GTGTAG |
| 887 | AGTTTGTAGT CGTG |
| 888 | GGAGTTTGTA GTCG |
| 889 | TCAGGAGTTT GTAGTC |
| 890 | GTTTCAGGAG TTTGTAGT |
| 891 | TCGGTTTCAG GAGT |
| 892 | TTGAGACTCC GGTA |
| 893 | ACCAGAAAAG TAGCTG |
| 894 | CCTGACCAGA AAAG |
| 895 | ATTCAGGCGT TCCA |
| 896 | GGTAAAAGTA CTGTCC |
| 897 | GGGTAAAAGT ACTGTC |
| 898 | GCACCTCCAC CGCTGCCA |
| 899 | CTCCTGCTCC TCGGTGAC |
| 900 | GCTTTGACAA AGCC |
| 901 | CTTGTGCAGA TCGT |
| 902 | TCATCTTGTG CAGATC |
| 903 | GTTCATCTTG TGCAGA |
| 904 | CGTGGTTCAT CTTG |
| 905 | TCACGTGGTT CATC |
| 906 | GGTTGGTGTA AACG |
| 907 | TACGAGCTCC CGGTCCCGAC |
| 908 | TAGCTGATGG TGGT |
| 909 | TCCTTGAAGG TGGA |
| 910 | TCTTCCATGT TGATGG |
| 911 | CTTTGATGCG CTCT |
| 912 | CTCCACTTTG ATGC |
| 913 | GCTCCAGCTT CCGCTTCCGG CACTTGGTGG |
| 914 | GGCCTTGAGC GTCTTCACCT TGTCCTCCAG |
| 915 | TGACCTTCTG TTTGAG |
| 916 | CATGACCTTC TGTTTG |
| 917 | GTCATGACCT TCTG |
| 918 | CGAGAACATC ATCG |
| 919 | GTAGTCTGCG TTGA |
| 920 | GCTGCAGCGG GAGGATGACG |
| 921 | AGTAAGAGAG GCTATC |
| 922 | GTAGTAAGAG AGGC |
| 923 | GGTAGTAAGA GAGG |
| 924 | GTGAGTGGTA GTAAGA |
| 925 | GTCCGTGCAG AAGTCCTG |
| 926 | GAATGAAGTT GGCACT |
| 927 | GGAATGAAGT TGGC |
| 928 | GGGAATGAAG TTGG |
| 929 | GCTGCACCAG CCACTGCAGG TCCGGACTGG |
| 930 | TCATGGTCTT CACAAC |
| 931 | CAATGCTCTG CGCTCGGCCT CCTGTCATGG |

FIG. 4-3

| | |
|---|---|
| 932 | CTAGAGTTCC TCAC |
| 933 | GAGTACGCTA GAGT |
| 934 | GAAGAGTACG CTAG |
| 935 | CTGCTTCCCA CCCAGCCCCC ACATTCCC |
| 936 | TTCATCCTCT GTACTGGGCT |
| 937 | GTTACGGATG TGCA |
| 938 | CAGTTACGGA TGTG |
| 939 | CCAGTTACGG ATGT |
| 940 | AGAGGTCTGAG TTGG |
| 941 | GTGAGACTCA GAGT |
| 942 | TCTTAGGGTG AGAC |
| 943 | GAGAGTACTT CTTAGG |
| 944 | GGAAGAAACT ATGAGAGT |
| 945 | CTTAGGGAAG AAACTATG |
| 946 | CGGTAAGAAA CTTAGG |
| 947 | AGCATGCGGT AAGA |
| 948 | GTCTGAAAGC ATGC |
| 949 | AGAACAAAGA AGAGCC |
| 950 | CAAGAGAACA AAGAAGAG |
| 951 | CAGCAAGAGA ACAAAG |
| 952 | TCCTCAGCAA GAGA |
| 953 | AGGTGTGACT TGCA |
| 954 | GAATAGGTGT GACTTG |
| 955 | CAGAATAGGT GTGACT |
| 956 | GCAGAATAGG TGTG |
| 957 | CAGTTGCAGA ATAGGT |
| 958 | GAAACCATTT CTGACC |
| 959 | TGTGAAACCA TTTCTGAC |
| 960 | CACTGTGAAA CCATTTCT |
| 961 | CCACTGTGAA ACCA |
| 962 | AGAACTGGCT CCTGCAGCTT CCCTGCTTCC |
| 963 | CACCTCCATT CACCC |
| 964 | CAGTAAAAGT GTCTGC |
| 965 | CGACATTCAG TAAAAGTG |
| 966 | GACCGACATT CAGT |
| 967 | CTTCTGGAGA TAACTAGA |
| 968 | CATCTTATTC CTTTCCCT |
| 969 | CAGCCATCTT ATTCCT |
| 970 | TGCAGCCATC TTATTC |
| 971 | GAGTGTATCA GTCAG |
| 972 | GGAGTGTATC AGTC |
| 973 | CTTGGAGTGT ATCAGT |
| 974 | ACAGAGTACC TACC |
| 975 | CCAACTTTCC CTTAAG |
| 976 | CCTTATGCTC AATCTC |
| 977 | GTCTTACTCA AGGG |
| 978 | ACAGTCTTAC TCAAGG |
| 979 | CATAAGACAC AGTCTTAC |
| 980 | GAAAGCATAA GACACAGT |
| 981 | GGAAAGCATA AGACAC |
| 982 | AGGGATAAAG GAAAGC |
| 983 | CCTGTATACA GAGG |
| 984 | TGTCTCCTGT ATACAG |

FIG. 4-4

| | |
|---|---|
| 985 | CATCTTCTAG TTGGTC |
| 986 | CTCATCTTCT AGTTGG |
| 987 | CTTCTCATCT TCTAGTTG |
| 988 | CAAAAGCAGAC TTCTCA |
| 989 | CTGCAAAGCA GACT |
| 990 | CTAGTTTTTC CTTCTCCT |
| 991 | TCTAGTTTTT CCTTCTCC |
| 992 | CAGGATGAAC TCTAGT |
| 993 | TCGTAGAAGG TCGT |
| 994 | AGGGTTACTG TAGC |
| 995 | GTAGTGGTGA TGTG |
| 996 | CGTCGTAGAA GGTC |
| 997 | TTTCGTGCAC ATCC |
| 998 | AGTTTGTAGT CGTGAAGA |
| 999 | CGAGAACATC ATGG |
| 1000 | GTAGTAGGAA ACGC |
| 1001 | GGTAGTAGGA AAGG |
| 1002 | GGAATGGTAG TAGG |
| 1003 | GGTCATTGAG AAGAG |
| 1004 | GCTAATGTTC TTGACC |
| 1005 | GCCAAGGTCCTCAT |
| 1006 | GGAGTCTATCTCCA |
| 1007 | CCAAAGAATCCTGACT |
| 1008 | CACATGCTTAGTGG |
| 1009 | CTCGTAAATGACCG |
| 1010 | AGGAATCTCGTAAATGAC |
| 1011 | CAGCAGCGATTCAT |
| 1012 | GGAGATCATCAAAGGA |
| 1013 | CTCAGCAATGGTCA |
| 1014 | GATCTCGAACACCT |
| 1015 | CACAATCTCGATCTTTCT |
| 1016 | CCTTCTTAAAGATTGGCT |
| 1017 | CACATACCAACTGG |
| 1018 | AGCTTGATGTGAGG |
| 1019 | GAAGTTGTAGCTTGATGT |
| 1020 | GCTTGAAGTTGTAGCT |
| 1021 | CTGCTTGAAGTTGTAG |
| 1022 | GACACAACTCCTCT |
| 1023 | TCCTTTGATAGACACAAC |
| 1024 | CTCGTTTGATAGACAC |
| 1025 | GGTTAGCACACACT |
| 1026 | GGTAACGGTTAGCA |
| 1027 | CGTAACACATTTAGAAGC |
| 1028 | CTCATCCGTAACAC |
| 1029 | CCGGTAAGTATTGTAGTT |
| 1030 | GGTGTATTTCCTTGAC |
| 1031 | ACATACCAACTGGTGT |
| 1032 | GTCCCTATACGAAC |
| 1033 | TTCATGTCTG TGCC |
| 1034 | GTAGGTGAGT TCCA |
| 1035 | GTTGTGAGCG ATGA |
| 1036 | CATAGTTGTC CTCAAAGA |
| 1037 | GGCATAGTTG TCCT |

FIG. 4-5

| | |
|---|---|
| 1038 | CATTGTCTAG CACG |
| 1039 | CTCCATTGTC TAGC |
| 1040 | GTATTGTTCA GCGG |
| 1041 | TACCGATCTC TGTGAG |
| 1042 | CACAAAATCG TGTCCT |
| 1043 | TCCTTCCACA AAATCG |
| 1044 | GTGGAAGATG TCCT |
| 1045 | TCTTGTGGAA GATGTC |
| 1046 | TCTATCAGTG TGAGAG |
| 1047 | GGTTGGTGTC TATC |
| 1048 | ACATCGGAGA ACAG |
| 1049 | CCTTACACAT CGGA |
| 1050 | ACAATCCTCA GAACTC |
| 1051 | GCTCTGACAA TCCT |
| 1052 | TGGTTGAAGT GGAG |
| 1053 | CTGTGGTTGA AGTG |
| 1054 | GTTGTAGGTG ACCA |
| 1055 | CTGTGTTGTA GGTG |
| 1056 | GACTCAAACG TGTC |
| 1057 | CATGGACTCA AACG |
| 1058 | CGAATGTATA CCGG |
| 1059 | CCGAATGTAT ACCG |
| 1060 | GCCGAATGTA TACC |
| 1061 | GTAGTTGTAG GGAC |
| 1062 | TAGAAAGGTA GTTGTAGG |
| 1063 | GTAGAAAGGT AGTTGTAG |
| 1064 | CGTAGAAAGG TAGTTG |
| 1065 | CCGTAGAAAG GTAG |
| 1066 | GACCATAGCA CACT |
| 1067 | GGATATTGGC ACTG |
| 1068 | CCTGGATATT GGCA |
| 1069 | GCTCCCAAAG ATCT |
| 1070 | CCCATCAAAG CTCT |
| 1071 | CAAACACTTG GAGC |
| 1072 | GTCTCAAACA CTTGGA |
| 1073 | GAGTCTCAAA CACTTG |
| 1074 | GTAACCTGTG ATCTCT |
| 1075 | GGTAACCTGT GATC |
| 1076 | GTATAGGTAA CCTGTG |
| 1077 | TGAGATGTAT AGGTAACC |
| 1078 | TGCTGAGATG TATAGG |
| 1079 | CCATGCTGAG ATGT |
| 1080 | GGATTACTTG CAGG |
| 1081 | TGTTATGGTG GATGAG |
| 1082 | GGTGTTATGG TGGA |
| 1083 | GCAGTTGACA CACT |
| 1084 | AGTACTCGGC ATTC |
| 1085 | CATTCACATA CTCCCT |
| 1086 | TCCAAAACAG GTCACT |
| 1087 | GGTCCTTATA GTGG |
| 1088 | CAGAATGCCA ACCA |
| 1089 | ACGAGAATGC CAAC |
| 1090 | GATCCCAAAG ACCA |

FIG. 4-6

| | |
|---|---|
| 1091 | TCGCTTGATG AGGA |
| 1092 | CATCGTGTAC TTCC |
| 1093 | GCATCGTGTA CTTC |
| 1094 | ACTGTGCCAA AAGC |
| 1095 | CTTGTAGACT GTGC |
| 1096 | CCCTTGTAGA CTGT |
| 1097 | TCAACACTTT GATGGC |
| 1098 | CCCTCAACAC TTTG |
| 1099 | GTGTTTTCCC TCAACA |
| 1100 | GTATGCTTCG TCTAAG |
| 1101 | CGTATGCTTC GTCT |
| 1102 | CCATCACGTA TGCT |
| 1103 | GCATAAGCTG TGTC |
| 1104 | CATGGTCTAA GAGG |
| 1105 | CAATCTGCAT ACACCA |
| 1106 | GGCAATCTGC ATAC |
| 1107 | CTGTCTCGTC AATG |
| 1108 | CATAACTCCA CACATC |
| 1109 | AGTCACACCA TAACTC |
| 1110 | ACAGTCACAC CATAAC |
| 1111 | CCCCAAAAGT CATC |
| 1112 | TCGTTAAGGTT TGGC |
| 1113 | GATCCCATCG TAAG |
| 1114 | CAATGGTGCA GATG |
| 1115 | GACATCAATG GTGC |
| 1116 | GTAGACATCA ATGGTG |
| 1117 | CATGATCATG TAGACATC |
| 1118 | CCATGATCAT GTAGAC |
| 1119 | CATTTGACCA TGATCATG |
| 1120 | CCAACATTTG ACCATG |
| 1121 | TCATCCAACA TTTGACCA |
| 1122 | GAGTCAATCA TCCAACAT |
| 1123 | CAGAGTCAAT CATCCA |
| 1124 | CCGACATTCA GAGT |
| 1125 | GAATTCAGAC ACCAAC |
| 1126 | GATGACCACA AAGC |
| 1127 | CCATCAAATA CATCGG |
| 1128 | TCACCATCAA ATACATCG |
| 1129 | CAACGTAGCC ATCA |
| 1130 | ACGTCTTTGA CGAC |
| 1131 | CAAAAACGTC TTTGACGA |
| 1132 | GGCAAAAACG TCTTTG |
| 1133 | CAAAGGCAAA AACGTC |
| 1134 | GTGTCAAGTA CTCG |
| 1135 | GTAATAGAGG TTGTCG |
| 1136 | CCCAGTAATA GAGG |
| 1137 | CATGGTGCTC ACTG |
| 1138 | GTGCCTGTAC GTAC |
| 1139 | TGCAGGTGGA TAGT |
| 1140 | CATGTCGATA GTCTTGCA |
| 1141 | GTCGATAGTC TTGC |
| 1142 | CCATGTCGAT AGTC |
| 1143 | CTCCATGTCG ATAG |

FIG. 4-7

| | |
|---|---|
| 1144 | CTTGGACAGG ATCT |
| 1145 | TGCTGTTGTA CAGG |
| 1146 | GTGCTGTTGT ACAG |
| 1147 | TTGGCGTAGT AGTC |
| 1148 | TCCACCATTA GCAC |
| 1149 | GATTTCGTTG TGGG |
| 1150 | GTCATAGATT TCGTTGTG |
| 1151 | TGTACTCTGC TTGAAC |
| 1152 | GTGTACTCTG CTTG |
| 1153 | TGCTGTGTGT ACTC |
| 1154 | CTGATGTGTT GAAGAACA |
| 1155 | CTCTGATGTG TTGAAG |
| 1156 | GCTCTGATGT GTTG |
| 1157 | GAGCTCTGAT GTGT |
| 1158 | CACTTTTAAC TTGAGCCT |
| 1159 | CTCCACTTTT AACTTGAG |
| 1160 | TGCTGTATTT CTGGTACA |
| 1161 | CCAGGAATTG TTGC |
| 1162 | TTGCTGAGGT ATCG |
| 1163 | GATAACCACT CTGG |
| 1164 | CAAAAGATAA CCACTCTG |
| 1165 | CGGTGACATC AAAAG |
| 1166 | CCTCAATTTC CCCT |
| 1167 | GTTATCCCTG CTGT |
| 1168 | GCAGTGTGTT ATCC |
| 1169 | GATGTCCACT TGCA |
| 1170 | TAGTGAACCC GTTG |
| 1171 | TGCCATGAAT GGTG |
| 1172 | GTTCATGCCA TGAATG |
| 1173 | CATGAGAAGC AGGA |
| 1174 | GCTTTGCAGA TGCT |
| 1175 | GAGCTTTGCA GATG |
| 1176 | TAGTTGGTGT CCAG |
| 1177 | CTGAAGCAAT AGTTGG |
| 1178 | AGCTGAAGCA ATAGTTGG |
| 1179 | GGAGCTGAAG CAAT |
| 1180 | CAATGTACAG CTGC |
| 1181 | GGAAGTCAAT GTACAG |
| 1182 | GGAAGTCAAT GTACAG |
| 1182 | CGGAAGTCAA TGTAC |
| 1183 | GCGGAAGTCA ATGT |
| 1184 | AGTTGGCATG GTAG |
| 1185 | GCAGAAGTTG GCAT |
| 1186 | CTCCAAATGT AGGG |
| 1187 | ACCTTGCTGT ACTG |
| 1188 | TGCTGGTTGT ACAG |
| 1189 | GGTTATGCTG GTTG |
| 1190 | GTAGTACACG ATGG |
| 1191 | CGTAGTACAC GATG |
| 1192 | CACGTAGTAC ACGA |
| 1193 | CATGTTGGAC AGCT |
| 1194 | GCACGATCAT GTTG |
| 1195 | CACACAGTAG TGCA |
| 1196 | GATCAGAAAA GCGC |

FIG. 4-8

```
1197  ACCGTGACCA GATG
1198  GTAGACAGGC TGAG
1199  TATCGAGTGT GCTG
1200  TTGCGCATGA ACTG
1201  TTGCTCAGGA TCTG
1202  ACTGGTGAGC TTCA
1203  GCTCAGGATA GTCT
1204  TGTAGATGGA AATCACCT
1205  TGGTGCTGTT GTAG
1206  TTCTCCTGGA GCAA
1207  TACTCTTCGT CGCT
1208  CTTGGCGTAG TACT
1209  CGGCATGTCT ATTTTGTA
1210  CGGGATGGCA TTTT
1211  CTGTAGAAAG TGGG
1212  ACAATTCTGA AGTAGGGT
1213  ATTGCTGAGA CGTCAAAT
1214  TCTCCATTGC TGAG
1215  TCACCAAATT GGAAGCAT
1216  CTCTGAACTC TGCT
1217  AACGAAAGAC TCTGAACT
1218  TGGGTTCTGC AAAC
1219  CTGGCTTTTG GGTT
1220  GTTGTTCAGG CACT
1221  TCTGATATAG CTCAATCC
1222  TCTTTGGACT TGAGAATC
1223  TGGGTTGGAG ATGT
1224  TGCTGTCGAT GTAG
1225  ACAACTTTGC TGTCGA
1226  ATTCGCCTTC TGCT
1227  GAAGGAGAGC CATT
1228  TCAGTTACAT CGAAGG
1229  TGAAGCCATT CATGAACA
1230  TCCTGTCTTT ATGGTG
1231  AAATCCCAGG TTCC
1232  GGACAGTGTA AGCTTATT
1233  GTACAAAAGT GCAGCA
1234  TAGATGGTAC AAAAGTGC
1235  CACTTTTATT TGGGATGATG
1236  GCAAATCTTG CTTCTAGT
1237  GTGCCATCAA TACC
1238  GGTATATGTG GAGG
1239  TCTGATCACC ACTG
1240  TCCTAGTGGA CTTTATAG
1241  TTTTTCCTAG TGGACT
1242  CAATAACATT AGCAGG
1243  AAGTCTGTAG GAGG
1244  TCTGTTGTGA CTCAAG
1245  GTTGGTCTGT TGTG
1246  CAAAGCACGC TTCT
1247  TTTCTAAAGC AATAGGCC
1248  GCAATTATCC TGCACA
1249  ACGTAGGCAG CAAT
```

FIG. 4-9

| | |
|---|---|
| 1250 | ATCAATGTAA AGTGGACG |
| 1251 | CTAGATCCCT CTTG |
| 1252 | CCATTTCCAC CCTA |
| 1253 | TGGGTTCGTG TATC |
| 1254 | TGGCATTGTA CCCT |
| 1255 | TCCAGCACAG AAGT |
| 1256 | ATAAATACGG GCATGC |
| 1257 | AGTGTCTGAA CTCC |
| 1258 | TGTGCTGAGT GTCT |
| 1259 | ATAAGCTCAG GACC |
| 1260 | AGGAGAAGCA GATG |
| 1261 | AGCAAGGAGA AGCA |
| 1262 | AATCTTGGGA CACG |
| 1263 | TAGAGAATGG TTAGAGGT |
| 1264 | GTTTTGCCAA TGTAGTAG |
| 1265 | CTTGGGTGTT TTGC |
| 1266 | GCAAGACTTT ACAATC |
| 1267 | GCATTTGCAA GACTTTAC |
| 1268 | TTTAGCTGCA TTTGCAAG |
| 1269 | GCCACTTTTC CAAG |
| 1270 | TTGGTCTTGC CACT |
| 1271 | CAGCACACAG TAGT |
| 1272 | CGATAGTCTT GCAG |

FIG. 5-1

| | | |
|---|---|---|
| 1273 | TGF-B2-14/1 | CTTTCACCAAATTGGAAG |
| 1274 | TGF-B2-14/2 | CACCAAATTGGAAGC |
| 1275 | TGF-B2-14/3 | TCACCAAATTGGAAGC |
| 1276 | TGF-B2-14/4 | CTCTGGCTTTTGGG |
| 1277 | TGF-B2-14/5 | CGGCATGTCTATTTG |
| 1278 | relA-1 | CACTACAGACGAGC |
| 1279 | relA-2 | CGTGCACTACAGACG |
| 1280 | relA-3 | GGAACAGTTCGTCC |
| 1281 | relA-4 | GAACAGTTCGTCCATG |
| 1282 | relA-5 | CCAGAGTTTCGGTTC |
| 1283 | relA-6 | CTAGGACTGGGACAG |
| 1284 | relA-7 | CGCACTTGTAGCG |
| 1285 | relA-8 | CTCGCACTTGTAGC |
| 1286 | relA-9 | GCACTTGTAGC |
| 1287 | relA-10 | GCGCACTGTCCCTG |
| 1288 | relA-11 | CCAGGGAGATGCGC |
| 1289 | relA-12 | GCCGGTGAGGAGG |
| 1290 | relA-13 | CCGGTGAGGAGGG |
| 1291 | relA-14 | CGGTTCACTCGGC |
| 1292 | relA-15 | GAGTTTCGGTTCACTC |
| 1293 | relA-16 | GGCACGATTGTCAAAG |
| 1294 | relA-17 | CAGGCGTCACCCCC |
| 1295 | relA-18 | GCAGGCGTCACCC |
| 1296 | p105/p50-1 | CTCCCTCCTAAGC |
| 1297 | p105/p50-2 | CCCTCCTAAGCGG |
| 1298 | p105/p50-3 | CGAGTCCGCGTTCG |
| 1299 | p105/p50-4 | CATCTTCTGCCATTC |
| 1300 | p105/p50-5 | GTGTTTTCCCACCAG |
| 1301 | p105/p50-6 | GGTTTTGGTTCACTAC |
| 1302 | p105/p50-7 | GCATCTTCACGTCTCC |
| 1303 | p105/p50-8 | CTTCACGTCTCCTGTC |
| 1304 | p105/p50-9 | GTCACCGCGTAGTC |
| 1305 | p105/p50-10 | CAAATAGGCAAGGTC |
| 1306 | p105/p50-11 | CTTGCAAATAGGCAAG |
| 1307 | p105/p50-12 | TGCTTGCAAATAGG |
| 1308 | p105/p50-13 | CTGCTTGCAAATAGG |
| 1309 | p105/p50-14 | GCAGGTGGATATTT |
| 1310 | p105/p50-15 | CTGCTGTTGGCAG |
| 1311 | p105/p50-16 | CACTAGTTTCCAAGT |
| 1312 | p105/p50-17 | GTTTTGGTTCACTAG |
| 1313 | p105/p50-18 | CTTTGATTTCAGGATAG |

FIG. 5-2

| | | |
|---|---|---|
| 1314 | p105/p50-19 | GCACTTCTTCTTTATCT |
| 1315 | p105/p50-20 | CCAAGTCAGATTTCC |
| 1316 | p105/p50-21 | GTTTCCAAGTCAGATTTC |
| 1317 | p105/p50-22 | GGTTCACTAGTTTCC |
| 1318 | p105/p50-23 | GGTTTTGGTTCACTAG |
| 1319 | p105/p50-24 | CCGAAAAATTGGGCA |
| 1320 | p105/p50-25 | CCGAAAAATTGGG |
| 1321 | p105/p50-26 | CTATCCGAAAAATTGG |
| 1322 | p105/p50-27 | GTTGATAATGTCATCAG |
| 1323 | p105/p50-28 | CTCATGTTGATAATGTC |
| 1324 | p105/p50-29 | CTGTCACCGCGTAG |
| 1325 | p105/p50-30 | CGTCTCCTGTCACCG |
| 1326 | p105/p50-31 | CTTCACGTCTCCTG |
| 1327 | p105/p50-32 | GAGAACTTTATCATGTC |
| 1328 | p105/p50-33 | GCTATATGCAGGG |
| 1329 | p105/p50-34 | CCAGCTGCTATATGCAGG |
| 1330 | p105/p50-35 | AGGCTAAATTTTGCCT |
| 1331 | p105/p50-36 | GGCTAAATTTTGCC |
| 1332 | p105/p50-37 | GGCTAAATTTTGCCTTC |
| 1333 | p105/p50-38 | GCAGGCTAAATTTTGCC |
| 1334 | p105/p50-39 | GAGTTACCCAAGCG |
| 1335 | p105/p50-40 | CAGAGTTACCCAAGCG |
| 1336 | p105/p50-41 | CAGAGTTACCCAAG |
| 1337 | p105/p50-42 | ACAGAGTTACCCAAG |
| 1338 | p105/p50-43 | GGTGCAAAACAGAG |
| 1339 | p105/p50-44 | CTAGGTGCAAAACAG |
| 1340 | p105/p50-45 | GAGAACTTTATCATGTCC |
| 1341 | p105/p50-46 | GCTAGATGAATGGC |
| 1342 | p105/p50-47 | GCAAACATGGCAGGC |
| 1343 | p105/p50-48 | CAGCAAACATGGCA |
| 1344 | p105/p50-49 | GCAGCAAACATGGC |
| 1345 | p105/p50-50 | AGCAGCAAACATGG |
| 1346 | p105/p50-51 | CAGCAGCAAACATG |
| 1347 | p105/p50-52 | AGCAGCAGCAAACA |
| 1348 | p105/p50-53 | CAGCAGCAGCAAACA |
| 1349 | p105/p50-54 | CAGCAGCAGCAAAC |
| 1350 | p105/p50-55 | CACCAGCAGCAGCA |
| 1351 | p105/p50-56 | GCATTGACGTCAGC |
| 1352 | p105/p50-57 | GATGTTGTCGTGCTC |
| 1353 | p105/p50-58 | TGAGATGTTGTCGTGCT |
| 1354 | p105/p50-59 | TGAGATGTTGTCGTG |

FIG. 5-3

| | | |
|---|---|---|
| 1355 | p105/p50-60 | GCCAATGAGATGTTG |
| 1356 | p105/p50-61 | CTGCCAATGAGATG |
| 1357 | p105/p50-62 | CACATGGGCATCAC |
| 1358 | p105/p50-63 | TGTCCACATGGGCA |
| 1359 | p105/p50-64 | GTACTGTCCACATG |
| 1360 | p105/p50-65 | CAGCTGCTATATGC |
| 1361 | p105/p50-66 | GTTCTCCACCAGGG |
| 1362 | p105/p50-67 | AGTTCTCCACCAGG |
| 1363 | p105/p50-68 | CAAAGTTCTCCACCAG |
| 1364 | p105/p50-69 | CCAAGAGTCATCCAGG |
| 1365 | p105/p50-70 | CCCAAGAGTCATCC |
| 1366 | p105/p50-71 | CCTGCATTTTCCCAAG |
| 1367 | p105/p50-72 | TCCTGCATTTTCCC |
| 1368 | p105/p50-73 | GCCATATCTAGAGGC |
| 1369 | p105/p50-74 | TCACATCTTCAGCC |
| 1370 | p105/p50-75 | GCTTCACATCTTCAGC |
| 1371 | p105/p50-76 | CAGCTTCACATCTTC |
| 1372 | p105/p50-77 | GTAACTTATACAGCTGC |
| 1373 | p105/p50-78 | CCAGTTTTTGTCTGG |
| 1374 | p105/p50-79 | CCATTTGTCTCAGG |
| 1375 | p105/p50-80 | GTGTAGCCCATTTG |
| 1376 | p105/p50-81 | GCTTCGGTGTAGCC |
| 1377 | p105/p50-82 | GATCACTTCAATTGCTTC |
| 1378 | p105/p50-83 | CTTGTGGAGGCAGG |
| 1379 | p105/p50-84 | GCTGCCTTGTGGAG |
| 1380 | p105/p50-85 | CTATTTGCTGCCTTGTGG |
| 1381 | p105/p50-86 | GGATGTCTCCACGC |
| 1382 | p105/p50-87 | CGAAGGATGTCTCC |
| 1383 | p105/p50-88 | TGCGGAAGGATGTC |
| 1384 | p105/p50-89 | GTTTGCGGAAGGATGTC |
| 1385 | p105/p50-90 | GCTGAGTTTGCGGA |
| 1386 | p105/p50-91 | GGTAAAGCTGAGTTTG |
| 1387 | p105/p50-92 | TCGGTAAAGCTGAG |
| 1388 | p105/p50-93 | GACTCGGTAAAGCTG |
| 1389 | p105/p50-94 | AGAGACTCGGTAAAGC |
| 1390 | p105/p50-95 | GAAATTGTCAGCAGGC |
| 1391 | p105/p50-96 | GAAATTGTCAGCAGG |
| 1392 | p105/p50-97 | GGAAATTGTCAGCAGG |
| 1393 | p105/p50-98 | GGAAATTGTCAGCAG |
| 1394 | p105/p50-99 | GGGAAATTGTCAGC |
| 1395 | p105/p50-100 | GTGTGGGAAATTGTC |

FIG. 5-4

| | | |
|---|---|---|
| 1396 | p105/p50-101 | GGTTTACACGGTGTG |
| 1397 | p105/p50-102 | GCTTTGGTTTACACG |
| 1398 | p105/p50-103 | GCACCTTTGGGATGC |
| 1399 | NFKB2-1 | CCAGGTTCTGCTTCC |
| 1400 | NFKB2-2 | GCTCTGTCTAGTGGC |
| 1401 | NFKB2-3 | ACTCTCCATGTCTC |
| 1402 | NFKB2-4 | CAACTCTCCATGTCTC |
| 1403 | NFKB2-5 | CAACTCTCCATGTC |
| 1404 | NFKB2-6 | AGCAACTCTCCATG |
| 1405 | NFKB2-7 | GTAGCAACTCTCCATG |
| 1406 | NFKB2-8 | GTAGCAACTCTCCA |
| 1407 | NFKB2-9 | GGTTGTAGCAACTCTCC |
| 1408 | NFKB2-10 | CGGGCAGTCCTCCA |
| 1409 | NFKB2-11 | GCACCGGGCAGTC |
| 1410 | NFKB2-12 | AGGCACCGGGCAG |
| 1411 | NFKB2-13 | GTGTGTTACCAGGTC |
| 1412 | NFKB2-14 | TGTGTGTTACCAGGT |
| 1413 | NFKB2-15 | TGGGTCACTGTGTG |
| 1414 | NFKB2-16 | CAGACTGTGGGCATG |
| 1415 | NFKB2-17 | CCCACCAGACTGTGGG |
| 1416 | NFKB2-18 | CCACCAGACTGTGG |
| 1417 | NFKB2-19 | TGCCCACCAGACTG |
| 1418 | NFKB2-20 | CGGCTTCCTCCCC |
| 1419 | NFKB2-21 | CCTTGTCTTCCACC |
| 1420 | NFKB2-22 | ACCGAGGCTGCCAC |
| 1421 | NFKB2-23 | GGAAGAAACCGAGG |
| 1422 | NFKB2-24 | GGGAAGAAACCGAG |
| 1423 | NFKB2-25 | GGCCATCTGCGCC |
| 1424 | NFKB2-26 | GCGGCCATCTGCG |
| 1425 | NFKB2-27 | GTGGCGGCCATCTG |
| 1426 | NFKB2-28 | ACCGTGGCGGCCAT |
| 1427 | NFKB2-29 | GCCGCTCAATCTTCATC |
| 1428 | NFKB2-30 | CTTCATCTTGTGATAGG |
| 1429 | NFKB2-31 | GCTCAATCTTCATCTTG |
| 1430 | NFKB2-32 | CAGAAACACTGTTACAG |
| 1431 | NFKB2-33 | CAGTTGCAGAAACACTG |
| 1432 | NFKB2-34 | GTTTCAGTTGCAGAAAC |
| 1433 | NFKB2-35 | CTTCCACCAGAGGG |
| 1434 | NFKB2-36 | GTCTTCCACCAGAG |
| 1435 | NFKB2-37 | CTTGTCTTCCACCAGAG |
| 1436 | NFKB2-38 | TCCTTGTCTTCCAC |

FIG. 5-5

| | | |
|---|---|---|
| 1437 | NFKB2-39 | CTTCCTTGTCTTCCAC |
| 1438 | NFKB2-40 | CATCTTGTGATAGGG |
| 1439 | NFKB2-41 | GCTAGGTGCAGTGGT |
| 1440 | NFKB2-42 | GATGGCTAGGTGCA |
| 1441 | NFKB2-43 | GTGGATGATGGCTAG |
| 1442 | NFKB2-44 | CCCGTGGATGATGG |
| 1443 | NFKB2-45 | CTGCCCGTGGATGA |
| 1444 | NFKB2-46 | AGAGCCTCCACCCA |
| 1445 | NFKB2-47 | GTTGTACTCTCGAGC |
| 1446 | NFKB2-48 | CGTTGTACTCTCG |
| 1447 | NFKB2-49 | CGCGTTGTACTCTC |
| 1448 | NFKB2-50 | GAGTCTCCATGCCG |
| 1449 | NFKB2-51 | CTGAGTCTCCATGC |
| 1450 | NFKB2-52 | CATGGCTGAGTCTC |
| 1451 | NFKB2-53 | TGCATGGCTGAGTC |
| 1452 | NFKB2-54 | GCGTTCACGTTGGC |
| 1453 | NFKB2-55 | GTGCGAGCGTTCAC |
| 1454 | NFKB2-56 | AGGTGCGAGCGTTC |
| 1455 | NFKB2-57 | GCAAAGGTGCGAGC |
| 1456 | NFKB2-58 | CCTGGTGGCTCAGG |
| 1457 | NFKB2-59 | GTCAGTCACCTGAG |
| 1458 | NFKB2-60 | CAGGTCAGTCACCTG |
| 1459 | NFKB2-61 | CAGCAGGTCAGTCAC |
| 1460 | NFKB2-62 | GCAGCAGGTCAGTC |
| 1461 | NFKB2-63 | CATTTAGCAGCAAGGTC |
| 1462 | NFKB2-64 | GCAGCATTTAGCAGC |
| 1463 | NFKB2-65 | CTGAGCAGCATTTAG |
| 1464 | NFKB2-66 | CCCATGAGAATCCT |
| 1465 | NFKB2-67 | CCTTCCCATGAGAATCC |
| 1466 | NFKB2-68 | TCCTCCCCTTCCCA |
| 1467 | NFKB2-69 | GCCTCCAGTAGACC |
| 1468 | NFKB2-70 | GTCAGACAGGGCCT |
| 1469 | NFKB2-71 | CCATGTCAGACAGG |
| 1470 | NFKB2-72 | GGCCCATGTCAGAC |
| 1471 | TANK-1 | GCTATTCCTGAAAATCAC |
| 1472 | TANK-2 | CCTCTTGTCTTCTTACC |
| 1473 | TANK-3 | GGAGAAGAAACCTCTTG |
| 1474 | TANK-4 | CCTTGCTGAAGTTTCTT |
| 1475 | TANK-5 | CCAAGACTCCTTGC |
| 1476 | TANK-6 | CCCTTTCATGGAGC |
| 1477 | TANK-7 | CCTCTTGGTGTGAC |

FIG. 5-6

| | | |
|---|---|---|
| 1478 | TANK-8 | GACTAAGGATGCCG |
| 1479 | TANK-9 | GTGGCAGGACTAAGG |
| 1480 | TANK-10 | AGACGTGGCAGGAC |
| 1481 | I-kappa-Bepsilon-1 | CTTCCAGCAGGCAG |
| 1482 | I-kappa-Bepsilon-2 | GTTCCTCTGCCTGG |
| 1483 | I-kappa-Bepsilon-3 | GATGTTCCTCTGCTG |
| 1484 | I-kappa-Bepsilon-4 | GAGATGTTCCTCTGCC |
| 1485 | I-kappa-Bepsilon-5 | GTGAGATGTTCCTCTG |
| 1486 | I-kappa-Bepsilon-6 | CAGAGAGTGAGATGTTCC |
| 1487 | I-kappa-Bepsilon-7 | CCAGAGAGTGAGATGTTC |
| 1488 | I-kappa-Bepsilon-8 | GGTCCAGAGAGTGAG |
| 1489 | I-kappa-Bepsilon-9 | GAGGTCCAGAGAGTG |
| 1490 | I-kappa-Bepsilon-10 | GGTCCTGTAGTGCC |
| 1491 | TRAF-6-1 | GATTTTATGATGCAGGC |
| 1492 | TRAF-6-2 | GACCTGCATCCCTTATTG |
| 1493 | TRAF-6-3 | TAGTTGATTTTCCAGCAG |
| 1494 | TRAF-6-4 | GAATCTCACGTTTTGC |
| 1495 | TRAF-6-5 | CAGAGAAAGAATCTCACG |
| 1496 | TRAF-6-6 | TTTCACCATCAGAGAAAAG |
| 1497 | TRAF-6-7 | CATTTGGACATTTCACC |
| 1498 | TRAF-6-8 | CCTTCATTTGGACATTTC |
| 1499 | TRAF-6-9 | CAATGTGCTTGATGATCC |
| 1500 | Rank-1 | CGCATCGGATTTCTC |
| 1501 | Rank-2 | CAAACCGCATCGGATTTC |
| 1502 | Rank-3 | GAACTGCAAACCGC |
| 1503 | Rank-4 | GCAGAGAAGAACTGC |
| 1504 | Rank-5 | GCAAGTAAACATGGG |
| 1505 | Rank-6 | GGTCCACGTTTTGG |
| 1506 | Rank-7 | GCAAGGGTCCACGTTT |
| 1507 | Rank-8 | TGCCTTCTTCTTCAGGG |
| 1508 | Rank-9 | TCCTGCTGGCTTCTTC |
| 1509 | Rank-10 | GTCCTGCTGGCTTC |
| 1510 | IL-5-1 | GGTAGTCTAGGAATTGG |
| 1511 | IL-5-2 | CTTGCAGGTAGTCTAGG |
| 1512 | IL-5-3 | GAAACTCTTGCAGGTAG |
| 1513 | IL-5-4 | CACCAAGAAACTCTTGC |
| 1514 | IL-5-5 | CATTACACCAAGAAACTC |
| 1515 | IL-5-6 | CTCGGTGTTCATTACACC |
| 1516 | IL-5-7 | CTTTCTATTATCCACTCG |
| 1517 | IL-5-8 | CCAGTTTAGTCTCAACTT |
| 1518 | IL-5-9 | AACCAGTTTAGTCTCAAC |

FIG. 5-7

| | | |
|---|---|---|
| 1519 | IL-5-10 | ACAAACCAGTTTAGTCTC |
| 1520 | IL-13-1 | CTCGCGAAAAAGTTTCTT |
| 1521 | IL-13-2 | CCCTCGCGAAAAAGTTTC |
| 1522 | IL-13-3 | GTCCCTCGCGAAAAAG |
| 1523 | IL-13-4 | CAGTTGAACCGTCCC |
| 1524 | IL-13-5 | GCTTTCGAAGTTTCAGTT |
| 1525 | IL-13-6 | GATGCTTTCGAAGTTTC |
| 1526 | IL-13-7 | CTGTCTCTGCAAATAATG |
| 1527 | IL-15-1 | CACTTATTACATTCACCC |
| 1528 | IL-15-2 | TTTTCCTCCAGTTCCTC |
| 1529 | IL-15-3 | GGACAATATGTACAAAACTC |
| 1530 | IL-15-5 | GTTGATGAACATTTGGAC |
| 1531 | IL-15-5 | GTGTTGATGAACATTTGG |
| 1532 | I-kappaB(newmember)-1 | CAAAATTTGGCCAGGG |
| 1533 | I-kappaB(newmember)-2 | GCCCAAAATTTGGCC |
| 1534 | I-kappaB(newmember)-3 | CCCAGCCCAAAATTTGG |
| 1535 | I-kappaB(newmember)-4 | GTCCCCAGCCCAAAATT |
| 1536 | I-kappaB(newmember)-5 | AAATCGCCAGAGGCTG |
| 1537 | I-kappaB(newmember)-6 | ACCAAATCGCCAGAGG |
| 1538 | I-kappaB(newmember)-7 | CATCACCAAATCGCCAG |
| 1539 | Prostaglan.Rec.EP3-1 | TAGGAGTGGTTGAGGC |
| 1540 | Prostaglan.Rec.EP3-2 | GTGTAGGAGTGGTTGAG |
| 1541 | Prostaglan.Rec.EP3-3 | CTGTGTAGGAGTGG |
| 1542 | Prostaglan.Rec.EP3-4 | CCCACATGCCTGTG |
| 1543 | Prostaglan.Rec.EP3-5 | CGATGAACAACGAG |
| 1544 | Prostaglan.Rec.EP3-6 | CTGGCGATGAACAACG |
| 1545 | Prostaglan.Rec.EP3-7 | CGCTGGCGATGAAC |
| 1546 | Prostaglan.Rec.EP3-8 | GAGCTAGTCCCGTTG |
| 1547 | Prostaglan.Rec.EP3-9 | GCGAAGAGCTAGTCC |
| 1548 | Prostaglan.Rec.EP3-10 | CCAGTTATGCGAAGAGC |
| 1549 | Prostaglan.Rec.EP3-11 | CCCCAGTTATGCGAAG |
| 1550 | PresenilinI-1 | CACATGCTTGGCGC |
| 1551 | PresenilinI-2 | CATCACATGCTTGGCG |
| 1552 | PresenilinI-3 | GACAAAGAGCATGATCAC |
| 1553 | PresenilinI-4 | GAGTCACAGGGACAAAG |
| 1554 | PresenilinI-5 | GAGAGTCACAGGGAC |
| 1555 | PresenilinI-6 | GCAGAGAGTCACAGG |
| 1556 | PresenilinI-7 | CCATGCAGAGAGTC |
| 1557 | PresenilinI-8 | CCACCATGCAGAGAG |
| 1558 | PresenilinI-9 | TAGCCACGACCACC |
| 1559 | PresenilinI-10 | GATTAGCTGCCCATCCTT |

FIG. 5-8

| | | |
|---|---|---|
| 1560 | PresenilinI-11 | GGTATAGATTAGCTGCC |
| 1561 | PresenilinI-12 | GTATCTTCTGTGAATGGG |
| 1562 | PresenilinI-13 | CTGGCCCACAGTCT |
| 1563 | PresenilinI-14 | CTCTGGCCCACAGT |
| 1564 | PresenilinI-15 | TGCAGGGCTCTCTG |
| 1565 | PresenilinI-16 | AGTGCAGGGCTCTC |
| 1566 | PresenilinI-17 | CACTGATCATGATGGC |
| 1567 | PresenilinI-18 | GACACTGATCATGATGGC |
| 1568 | PresenilinI-19 | ACAATGACACTGATCATG |
| 1569 | PresenilinI-20 | GAACCACCAGGAGGAT |
| 1570 | PresenilinI-21 | GACACAAAACAGCCACT |
| 1571 | PresenilinI-22 | GTGGACCTTTCGGAC |
| 1572 | PresenilinI-23 | CAACCAGCATACGAAGT |
| 1573 | PresenilinI-24 | TCCCTCTGGGCTTC |
| 1574 | PresenilinI-25 | ACTGTCCCTCTGGG |
| 1575 | PresenilinI-26 | GACTGTCCCTCTGG |
| 1576 | PresenilinI-27 | CCTAGATGACTGTCCC |
| 1577 | PresenilinI-28 | CAGCGAGGATACTGC |
| 1578 | PresenilinI-29 | CTTCACCAGCGAGGAT |
| 1579 | PresenilinI-30 | TTTCCTCTGGGTCTTCAC |
| 1580 | PresenilinI-31 | CTTTCCTCTGGGTCTTC |
| 1581 | PresenilinI-32 | CTCCCAATCCAAGTTTT |
| 1582 | TRADD-1 | TTCATCCCCGGAGCC |
| 1583 | TRADD-2 | TTCTTCATCCCGGAGC |
| 1584 | TRADD-3 | GCTCAGCCAGTTCTTC |
| 1585 | TRADD-4 | GACAGAGAGGGCAC |
| 1586 | TRADD-5 | CTTCACCTCCGACAG |
| 1587 | TRADD-6 | GAAAAGTCTGGGCAGG |
| 1588 | TRADD-7 | GACCCTGGAACAGAAAAG |
| 1589 | TRADD-8 | CTGACCCTGGAACAG |
| 1590 | TRADD-9 | ACTACAGGCTGACCCT |
| 1591 | TRADD-10 | ATTCACTACAGGCTGACC |
| 1592 | TRADD-11 | CGATTCACTACAGG |
| 1593 | TRADD-12 | GGCCGATTCACTAC |
| 1594 | TRADD-13 | CGAACGTCTGTTGGTC |
| 1595 | TRADD-14 | CGCGAACGTCTGTTG |
| 1596 | PKA-1 | CTTCTGTTTGTCGAGGAT |
| 1597 | PKA-2 | TTCACCACCTTCTGTTTG |
| 1598 | PKA-3 | AGGATGCGCTTTTCATTC |
| 1599 | PKA-4 | AGCTTGCAGGATGCG |
| 1600 | PKA-5 | GTTGACAGCTTGCAGGAT |

FIG. 5-9

| | | |
|---|---|---|
| 1601 | PKA-6 | GGAACGGAAAGTTGACAG |
| 1602 | PKA-7 | AACTCGAGTTTGACGAGG |
| 1603 | PKA-8 | TGTCCTTGAAGGAGAAC |
| 1604 | PKA-9 | CGTACTCCATGACCATGT |
| 1605 | PKA-10 | GCACGTACTCCATGAC |
| 1606 | PKA-11 | GATTCTCCGGCTTCAG |
| 1607 | PKA-12 | TCAATGAGCAGATTCTCC |
| 1608 | PKA-13 | GGTCAATGAGCAGATTC |
| 1609 | PKA-14 | CCCTGCTGGTCAATG |
| 1610 | PKA-15 | TAGCCCTGCTGGTC |
| 1611 | PKA-16 | CGCTTGGCGAAACC |
| 1612 | PKA-17 | CCTTCACGCGCTTG |
| 1613 | PKA-18 | AAGGTCCAAGTGCG |
| 1614 | PKA-19 | TGCCGCACAAGGTC |
| 1615 | IL-12alpha-1 | GGTGAGGACCACCATTT |
| 1616 | IL-12alpha-2 | GGGTGTCACAGGTG |
| 1617 | IL-12alpha-3 | ATACCATCTTCTTCAGGG |
| 1618 | IL-12alpha-4 | GGTGATACCATCTTCTTC |
| 1619 | IL-12alpha-5 | CCAGGTGATACCATCTTC |
| 1620 | IL-12alpha-6 | CCTCACTGCTCTGGT |
| 1621 | IL-12alpha-7 | TAAGACCTCACTGC |
| 1622 | IL-12alpha-8 | CAGAGCCTAAGACCTC |
| 1623 | IL-12alpha-9 | CCAGAGCCTAAGACC |
| 1624 | IL-12alpha-10 | TCTTCCTTTTTGTGAAGC |
| 1625 | IL-12alpha-11 | GACCAAATTCCATCTTCC |
| 1626 | IL-12alpha-12 | ATCAGTGGACCAAATTCC |
| 1627 | IL-12alpha-13 | GGTTCTTCTGGTCCTTT |
| 1628 | IL-12alpha-14 | TTTTTGGGTTCTTCTGG |
| 1629 | IL-12alpha-15 | GGTCTTATTTTGGGTTC |
| 1630 | IL-12alpha-16 | AATGGGCAGACTCTCCT |
| 1631 | IL-12alpha-17 | TCCACCATGACCTCAATG |
| 1632 | IL-12alpha-18 | AACGGCATCCACCATG |
| 1633 | IL-12alpha-19 | GTGAACGGCATCCAC |
| 1634 | IL-12alpha-20 | ACTTGAGCTTGTGAACGG |
| 1635 | IL-12alpha-21 | TTCATACTTGAGCTTGTG |
| 1636 | IL-12alpha-22 | CTGGTGTAGTTTTCATAC |
| 1637 | IL-12alpha-23 | AGCTGCTGGTGTAGTTTT |
| 1638 | IL-12beta-1 | AGGAGGACCAGGGT |
| 1639 | IL-12beta-2 | AGGTGGTCCAGGAG |
| 1640 | IL-12beta-3 | TTTCTGGCCAAACTGAGG |
| 1641 | IL-12beta-4 | GGAGGTTTCTGGCC |

FIG. 5-10

| | | |
|---|---|---|
| 1642 | IL-12beta-5 | TCTGGAGTGGCCAC |
| 1643 | IL-12beta-6 | CTTCTGGAGCATGTTGCT |
| 1644 | IL-12beta-7 | GCCTTCTGGAGCATG |
| 1645 | IL-12beta-8 | GTTTGTCTGGCCTTCTG |
| 1646 | IL-12beta-9 | GAGTTTGTCTGGCCTTCT |
| 1647 | IL-12beta-10 | CTAGAGTTTGTCTGGCCT |
| 1648 | IL-12beta-11 | GCAAGGGTAAAATTCTAG |
| 1649 | IL-12beta-12 | AGTGCAAGGGTAAAATTC |
| 1650 | IL-12beta-13 | AAACAGGCCTCCACT |
| 1651 | IL-12beta-14 | CTTGGTTAATTCCAATGG |
| 1652 | IL-12beta-15 | AGGCAACTCCCATTAGTT |
| 1653 | IL-12beta-16 | TACTACTAAGGCACAGGG |
| 1654 | IL-12beta-17 | AATACTACTAAGGCACAG |
| 1655 | IL-12beta-18 | GTACATCTTCAAGTCTTC |
| 1656 | Pg-R | GGAGTGGACATGAT |
| 1657 | thr | AAGAAGATGAAGCCTTTG |
| 1658 | ref-fosjun | CCGTCTTACTCTTCTTGG |
| 1659 | PIV | CCGATACAATTCCAAGG |
| 1660 | PIV | CCTTTTCCTTCTGAG |
| 1661 | PIV | CTGTTGCAAGTACG |
| 1662 | bak | CAGAAGCAGAGGGC |
| 1663 | bak | CCTCAGAAGCAGAGG |
| 1664 | bak | CTCCTCAGAAGCAG |
| 1665 | bak | ACAGGCTGGTGGCA |
| 1666 | bak | CCACTCTCAAACAGGC |
| 1667 | bak | ACGGTAGCCGAAGC |
| 1668 | bak | GACGGTAGCCGAAGC |
| 1669 | bak | GGCCAGACGGTAGC |
| 1670 | bak | GTGTAGGGCCAGACGGTA |
| 1671 | bak | CCGAAGCCATTTTTCAGG |
| 1672 | bak | CCCCGAAGCCATTTTTC |
| 1673 | bak | GGTTGATGTCGTCC |
| 1674 | bak | GCTTGAGACACTCGC |
| 1675 | bak | CCGGACCCGTCCAT |
| 1676 | bclx | GCTTGCTTTACTGC |
| 1677 | bclx | GGTTGCTCTGAGAC |
| 1678 | bclx | GCCACAGTCATGCC |
| 1679 | bmp | CGGGCATGCTGGCG |
| 1680 | bmp | GTGAAGTTCAGGATGATC |
| 1681 | bmp | CCAGTGCCTCATGG |
| 1682 | ICE | CAGTGTTCTCCATGG |

FIG. 5-11

| | | |
|---|---|---|
| 1683 | ICE | CTGTACCAGACCGAG |
| 1684 | ICE | GCATACTGTTTCAGC |
| 1685 | ich | GCCATCAGCTCCTTG |
| 1686 | ich | CCACACCATAGATGG |
| 1687 | ich | GCTGGAGCAGTTTCC |
| 1688 | bcl1 | CTCGCTTCTGCTGC |
| 1689 | bcl2 | ACCGTGGCAAAGCG |
| 1690 | mucrep | AGGTGACACCGTGG |
| 1691 | AHR | GACTTGATTCCTTCAG |
| 1692 | AHR | GGATTTGACTTGATTCC |
| 1693 | AHR | GCTGCTGTTCATGG |
| 1694 | CD2 | CCGTTTCTTTCAGTAGG |
| 1695 | MEK2 | CTTGAAGTAGGAGC |
| 1696 | tnf | CGCTCCTACATGGC |
| 1697 | tnf | GATGAGGTACAGGCC |
| 1698 | tnf | GTAGATGAGGTACAG |
| 1699 | tnf | GAGTAGATGAGGTAC |
| 1700 | tnf | CCTGGGAGTAGATG |
| 1701 | tnf | GGACCTGGGAGTAG |
| 1702 | tnf | ACATGGGTGGAGGG |
| 1703 | tnf | GTGCTCATGGTGTC |
| 1704 | tnf | CTTTCAGTGCTCATG |
| 1705 | tnf | TGCTTTCAGTGCTCA |
| 1706 | tnf | GATGATCTGACTGCC |
| 1707 | tnf | GTTCGAGAAGATGATC |
| 1708 | tnf | GGGTTCGAGAAGATG |
| 1709 | tnf | GGTTTGCTACAACATG |
| 1710 | tnf | CAGCTTGAGGGTTTG |
| 1711 | tnf | TGCCCCTCAGCTTG |
| 1712 | TNFR | GACACACACTATCTC |
| 1713 | IL-18 | GCAGCCATCTTTATTC |
| 1714 | IL-18 | GTTCAGCAGCCATC |
| 1715 | IL-18 | TGGTTCAGCAGCCA |
| 1716 | IL-18 | CTACTGGTTCAGCAGC |
| 1717 | IL-18 | TCTACTGGTTCAGC |
| 1718 | IL-18 | GCCACAAAGTTGATGC |
| 1719 | IL-18 | CATTGCCACAAAGTTG |
| 1720 | IL-18 | GAGAACTTGGTCATTC |
| 1721 | IL-18 | GGTCAATGAAGAGAAC |
| 1722 | IL-18 | CGATTTCCTTGGTC |
| 1723 | IL-18 | CCGATTTCCTTGGTC |

FIG. 5-12

| | | |
|---|---|---|
| 1724 | IL-18 | CAAATAGAGGCCGATTTC |
| 1725 | IL-18 | CAAATAGAGGCCGA |
| 1726 | IL-18 | CCTCTAGGCTGGCT |
| 1727 | IL-18 | CATACCTCTAGGCTG |
| 1728 | IL-18 | AGCCATACCTCTAG |
| 1729 | IL-18 | CAGCCATACCTCTAG |
| 1730 | IL-18 | CACAGAGATAGTTACAG |
| 1731 | IL-18 | GTCTTCGTTTTGAACAG |
| 1732 | IL-18 | CTAGTCTTCGTTTTGAAC |
| 1733 | IL-18 | TAGCTAGTCTTCGTTTTG |
| 1734 | IL-18 | GAGCCACTGCGCC |
| 1735 | IL-18 | CGTGAGCCACTGCG |
| 1736 | IL-12-Rec | CGTAACGATCACTGG |
| 1737 | IL-12-Rec | GCACTCGTAACGATC |
| 1738 | IL-12-Rec | GGAGCACTCGTAAC |
| 1739 | IL-12-Rec | CATCATCCTGAGGT |
| 1740 | IL-12-Rec | CAGTATCATCATCCTG |
| 1741 | IL-12-Rec | CTCAGTATCATCATCC |
| 1742 | IL-12-Rec beta2 | CTAAAAGTATGTGCCATC |
| 1743 | IL-12-Rec beta2 | CACATCGCCTCTCT |
| 1744 | IL-12-Rec beta2 | GCTTCACAGTCACATCGC |
| 1745 | IL-12-Rec beta2 | GGAAGGCTTCACAGTC |
| 1746 | IL-12-Rec beta2 | CCTGTGACTTGAGAATTG |
| 1747 | IL-12-Rec beta2 | GGAAGACCTGTGAC |
| 1748 | IL-12-Rec beta2 | CTCTGCTCCACATATTTG |
| 1749 | IL-12-Rec beta2 | CAACGAAGATCTCTG |
| 1750 | IL-12-Rec beta2 | CAACACCAACGAAG |
| 1751 | PKC-beta | GGTCTTCTGTTTGC |
| 1752 | CB-1-Rec | CGATGAAGTGGTAGGAAG |
| 1753 | TGF-alpha | GGTTGCATGGAAGC |
| 1754 | Fascin | GGTCACAAACTTGCC |
| 1755 | p300 | CTGATTTGGTCCACTAG |
| 1756 | CBP | CATGTTAGCACTGTTC |
| 1757 | rac-alpha | GGTCTTGATGTACTCC |
| 1758 | EBV | CCACCTAAAGAGAGATC |
| 1759 | HSPQ | CTTGTACTGCACCATC |
| 1760 | CC-CKR1 | GCCAGTTAAGAAGATG |
| 1761 | CC-CKR4 | GAGATCATGATCCATGG |
| 1762 | c-CRK | GTAGTGTCCCAATAGTG |
| 1763 | c-CRK | CTTCCTCATCATTCCC |
| 1764 | CRKL | CACAAGCTTTTCGAC |

ANTISENSE OLIGONUCLEOTIDE PREPARATION METHOD

This application is a 371 of PCT EP 98/00497, Jan. 30, 1998.

The present invention is related to a method for the preparation of antisense oligonucleotides and to an oligonucleotide or functional or structural analogs or effective derivatives thereof, forming hydrogen bonds with deoxyribonucleic acids (DNA) and/or ribonucleic acids (RNA) or derivatives thereof including, but not limited to the formation of hydrogen bonds with the bases adenine (A), cytosine (C), guanine (G), uracil (U) or thymidine (T) contained in such molecules or forming hydrogen bonds with residues of a particular protein, such a molecule being capable of altering the expression structure or function, of a gene, an RNA molecule or a protein or altering the level of activity of a gene, an RNA molecule or a protein. Furthermore, the present invention is related to such nucleic acid or functional or structural analogs or effective derivatives thereof, coupled or mixed with folic acid, hormones, steroid hormones such as oestrogen, progesterone, corticosteroids, mineralocorticoids, androgens, peptides, proteoglycans, phospholipids, glycolipids and derivatives therefrom.

Furthermore, the invention is related to the use of said nucleic acids or functional or structural analogs or effective derivatives thereof, for analyzing the functional properties of a particular gene, RNA, or protein by altering its activity, structure, function or altering its expression levels.

Furthermore, the invention is related to antisense nucleic acids, capable of modulating the expression or functional activity of proteins which regulate cell growth leading to augmentation, inhibition or modulation of cell growth or cell proliferation and/or the expansion of primary cells or stem cells, e.g. in culture or in the living organism.

Furthermore, the invention is related to a pharmaceutical composition comprising said nucleic acids or functional or structural analogs or effective derivatives thereof, hybridizing with an area of the messenger RNA (mRNA) or the DNA of a target gene or binding to a particular protein as well as the use of said nucleic acids, structural analogs and derivatives thereof for the manufacturing of a pharmaceutical composition for the treatment of diseases where the alteration of the structure function, activity or expression of a particular target gene, a particular target RNA or a particular target proteins activity leads to a therapeutic benefit related to the effect of the nucleic acid or derivative thereof.

Modulation of the expression of genes, RNA molecules or proteins or of their activity levels with nucleic acids or functional or structural analogs or effective derivatives thereof is a powerful means to study the function of the respective molecules. For example modulation, e. g. knockdown or increase of the expression of a particular protein can lead to the identification of its physiological as well as its pathophysiological roles in cultured cells as well as in living organisms in vivo.

Furthermore, the aberrant expression or overexpression of genes, RNA molecules or proteins, the expression of foreign DNA, RNA or proteins e. g. derived from infectious organisms or the expression of mutated DNA, RNA and proteins is found in a variety of diseases. Downregulation of the expression or the activity of such DNA, RNA and/or proteins can lead to an inhibition of or to the reversal of pathological processes in which the expression of a particular DNA, RNA and/or protein plays a role. However, nucleic acids or derivatives thereof used for downregulation of DNA, RNA and/or protein expression are often ineffective and/or toxic to the cells or the organisms treated with such molecules.

An object of the present invention is to provide a method for designing and preparation of oligonucleotides or derivatives thereof which avoid the drawbacks of prior art, and give a reliable method for preparation of oligonucleotides having increased effectivity and/or reduced toxicity and/or reduced non-selective effects.

The object is attained by a method having the features of claim 1. Preferred embodiments of the method of the invention are those according to claims 2 to 7.

The method of the invention comprises the steps of selecting a target nucleic acid, if necessary elucidating its sequence generating the antisense oligonucleotide with the proviso that the oligonucleotide comprises at least 8 residues, the oligonucleotide comprises at maximum twelve elements, which are capable of forming three hydrogen bonds each to cytosine bases, the oligonucleotide does not contain four or more consecutive elements, capable of forming three hydrogen bonds each with four consecutive cytosine bases (CCCC) within the target molecule or alternatively four or more consecutive elements of GGGG, the oligonucleotide does also not contain 2 or more series of three consecutive elements, capable of forming three hydrogen bonds each with three consecutive cytosine bases (CCC) within the target molecule, or alternatively 2 or more series of three consecutive elements of GGG, and the ratio between residues forming two hydrogen bonds per residue (2H-bond-R) with the target molecule and those residues forming three hydrogen bonds per residue (3H-bond-R) with the target molecule, is ruled by the following specifications:

$$\frac{3H\text{-bond-}R}{3H\text{-bond-}R + 2H\text{-bond-}R} \geq 0.29$$

and synthesizing the oligonucleotide thus generated in a per se known manner.

The generated antisense oligonucleotide comprises at least 8 residues in order to have sufficient interaction with the target molecule and has preferably up to 30, more preferably up to 24 or most preferred upt to 18 residues. Shorther chain length are preferred over longer ones to increase specifity and/or reduce non-specific effects.

The oligonucleotide comprises at maximum 12 elements which are capable of forming 3 hydrogen bonds each to cytosine bases. In case of generating an oligonucleotide an element is represented by a residue, thus a nucleotide of the oligonucleotide. In cases of generating a derivative an element is considered as a part of the molecule capable of forming hydrogen bonds. It is preferred that the oligonucleotide comprises at maximum 10 and more preferred at maximum 8 elements which are capable of forming 3 hydrogen bonds each to cytosine bases.

The generated antisense oligonucleotide preferably does not contain 4 or more consecutive guanine bases and does also not contain 2 or more series of 3 consecutive guanine bases.

Preferably, the ratio between residues forming 2 hydrogen bonds per residue (2H-bond-R) with their target molecule and those residues forming 3 hydrogen bonds per residue (3H-bond-R):

$$\frac{3H\text{-bond-}R}{3H\text{-bond-}R + 2H\text{-bond-}R}$$

is in the range of greater than 0.33 and smaller than 0.86, more preferably smaller than 0.79 and still more preferred smaller than 0.72.

In one embodiment the oligonucleotides generated by the method of the invention are modified for higher nuclease resistance than naturally occurring nucleotides. Methods for synthezing oligonucleotides and derivatives thereof are known in the art, see for exammple "Oligonucleotides and Analogues", F. Eckstein (Ed.), 1991, IRL Press Oxford or "Protocols for Oligonucleotides and Analogs, Synthesis and Properties", Sudhir Agrawal (Ed.), 1993, Humana Press, Totowa, N.J.

Oligonucleotides of the invention may also contain RNA and DNA residues within their chains.

The modifications can be made to the bases, the sugars or the linkages of the oligonucleotides. Preferably, the modifications are phosphorothioate (S-ODN) internucleotide linkages, and/or methylphosphonate internucleotide linkages, N'3->P5' phosphoramidate linkages, peptide linkages or 2'-methoxyethoxy modifications of the sugar moiety or modifications of the bases. In a preferred embodiment the oligonucleotide has at least two different types of modifications and more preferably at least two different types of internucleotide linkages. In another preferred embodiment the oligonucleotides are linked to or mixed with folic acid, hormones such as steroid hormones or corticosteroids, peptides, proteoglycans, glycolipids, phospholipids or derivatives thereof.

Surprisingly the molecules, obtainable according to the method of the invention could strongly reduce or avoid toxicity and/or non-specific effects of such molecules and/or had significantly higher activity than sequences selected otherwise. Preferably, the molecules according to the invention have the following features: They do not contain four or more consecutive guanosine ($N_aGGGGN_b$) or inosine ($N_aIIIIN_b$) residues and the oligonucleotide does not contain two or more series of three or more consecutive guanosine residues ($N_aGGGN_cGGGN_b$) and does not contain two ore more series of three or more consecutive inosine residues ($N_aIIIN_cIIIN_b$), wherein $N_a$, $N_b$, $N_c$ represent indepently oligonucleotides of any sequence having 0 to 20 residues.

In a preferred embodiment the molecule contains a minimum of 10 residues capable of forming either two or three hydrogen bonds per residue. Furthermore, the molecule contains a maximum of 24 consecutive residues linked by phosphorothioate linkages capable of forming either two or three hydrogen bonds per residue. In molecules according to the invention which contain more than 18 residues the additional linkages preferably consist of methylphosphonate linkages or phosphodiester linkages.

The chemical structures of antisense oligodeoxyribonucleotides are given in FIG. 1.

Figure 2:
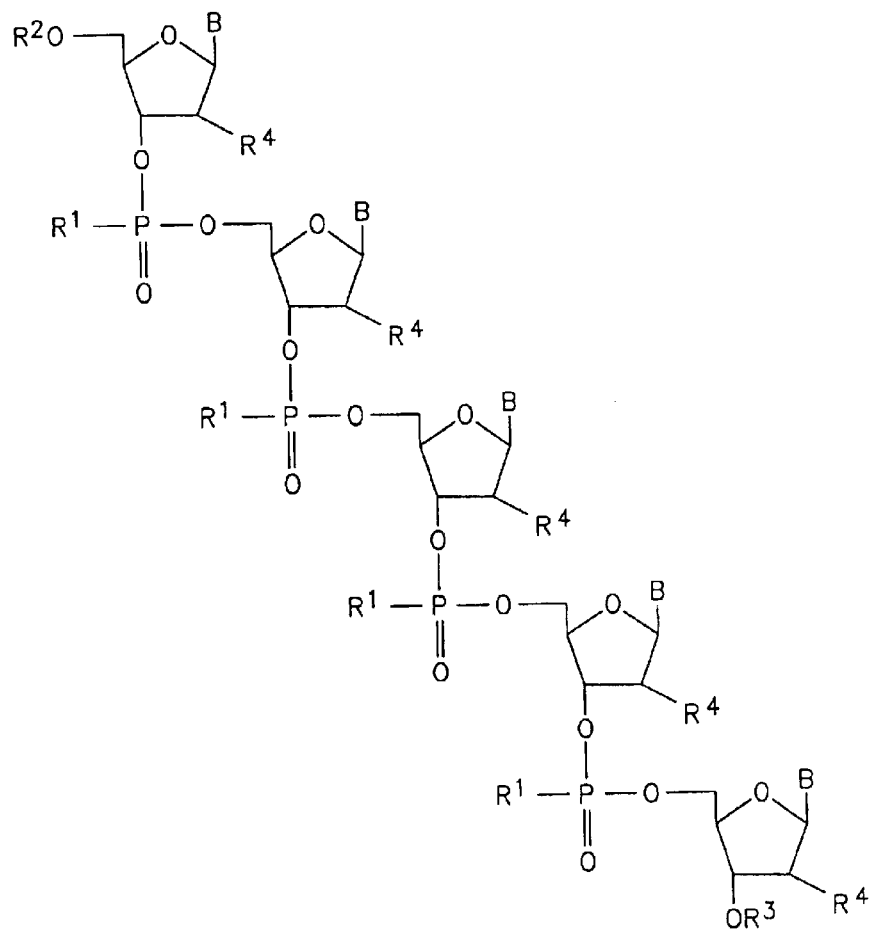

The chemical structures of antisense oligoribonucleotides are given in FIG. 2. The oligonucleotide is to be understood as a detail out of a longer nucleotide chain.

Of course, the oligonucleotides may be composed of elements of either figures.

In FIGS. 1 and 2, lit. B means an organic base such as adenine (A), guanine (G), cytosine (C), inosine (I), uracil (U) and thymine (T) which are coupled to the deoxyribose. The linkages between the nucleotides are either phosphodiester bonds as in naturally occurring DNA or linkages spacing the nucleotides in such a way to allow hybridization with its target nucleic acid or binding to a protein in order to regulate its activity, such as e.g. phosphorothioate linkages, methylphosphonate linkages, phosphoramidate linkages or peptide linkages.

$R_2$ and $R_3$ represent further residues of the oligonucleotide or derivative.

$R_4$ represents OH or a modification such as a 2'-methoxy ethoxy derivative.

The modifications of the phosphodiester linkage, shown in FIGS. 1 and 2 can be selected from, but are not limited to.

1. Oligodeoxy-ribonucleotides or oligoribionucleotides substituted by
   1.1. R1=O
   1.2. R1=S
   1.3. R1=F
   1.4. R1=$CH_3$
   1.4. R1=OEt
2. oligodeoxy-ribonucleotides where R1 is varied at the internucleotide phosphates within one oligonucleotide

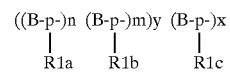

where lit. p stands for the phosphodiester or the phosphoramidate linkage, modified by coupling to R1a, R1b or R1c or for a peptide linkage, or for linkages spacing the nucleotides in such a way to allow hybridization with its target nucleic acid or binding to a protein in order to regulate its activity, structure, function or expression level.

where lit. B=any deoxy-ribonucleotide or ribonucleotide depending on gene sequence according to the invention.

n, m, x, y=integers 0–20

Preferred maximal length of the total number of bases is 30.

| | | | |
|---|---|---|---|
| 2.1 | $R_{1a}=S$ | $R_{1b}=CH_3$ | $R_{1c}=S$ |
| 2.2 | $R_{1a}=S$ | $R_{1b}=CH_3$ | $R_{1c}=O$ |
| 2.2 | $R_{1a}=S$ | $R_{1b}=O$ | $R_{1c}=S$ |
| 2.2 | $R_{1a}=S$ | $R_{1b}=O$ | $R_{1c}=CH_3$ |
| 2.3 | $R_{1a}=CH_3$ | $R_{1b}=S$ | $R_{1c}=CH_3$ |
| 2 4 | $R_{1a}=CH_3$ | $R_{1b}=S$ | $R_{1c}=O$ |
| 2.5 | $R_{1a}=CH_3$ | $R_{1b}=O$ | $R_{1c}=CH_3$ |
| 2.6 | $R_{1a}=CH_3$ | $R_{1b}=O$ | $R_{1c}=S$ |
| 2.7 | $R_{1a}=O$ | $R_{1b}=S$ | $R_{1c}=O$ |
| 2.8 | $R_{1a}=O$ | $R_{1b}=S$ | $R_{1c}=CH_3$ |
| 2.9 | $R_{1a}=O$ | $R_{1b}=CH_3$ | $R_{1c}=O$ |
| 2.10 | $R_{1a}=O$ | $R_{1b}=CH_3$ | $R_{1c}=S$ |

Preferably, the oligonucleotide comprises a minimum of 10 elements and a maximum of 24 elements capable of forming either 2 or 3 hydrogen bonds per element. The oligonucleotides of the invention can have modifications to the base, the sugar or the phosphate moiety. Preferred modifications are phosphorothioate (S-ODN) internucleotide linkages, and/or methylphosphonate internucleotide linkages, N'3->P5' phosphoramidate linkages, peptide linkages or 2'-methoxyethoxy modifications of the sugar or modifications of the bases. In a very preferred embodiment the antisense oligonucleotides comprise the sequences 41 to 73, 74 to 106, 154 to 172, 173 to 203, 298 to 380, 476 to 506, 519 to 556 and 597 to 641 of FIG. 3 and 1273–1764 of FIG. 5. A further aspect of the invention is the use of the oligonucleotides of the invention for the inhibition of the genes p53, rb, junD, junB, TGF-β1, TGF-β2 to influence cell proliferation, in particular of primary cell cultures such as liver cells, kidney cells, osteoclasts, osteoblasts and/or keratinocytes and/or cells of the blood lineage, such as bone marrow stem cells, and/or progenitor cells of red and white blood cells and/or organ stem cells.

The Sequences 41–73 and/or 74–106 and/or 154–203 and/or 519–556 and/or 597–641 and/or 1273–1277 and/or 1481–1490 and/or 1532–1549 and/or 1656 are useful for the treatment and/or prevention of immunosuppressive disorders including, but not limited to immunosuppression in neoplastic diseases—including gliomas and other brain tumors, sarcomas, carcinomas and lymphomas—and/or immunosuppression as side effect from drugs, including, but not limited to side effects from cytotoxic agents and/or immunosuppression in AIDS patients.

In a further embodiment of the invention these sequences are also useful for the treatment and/or prevention of hyoproliferation of normal cells, including, but not limited to immune cells, bone marrow stem cells, endothelial cells, organ stem cells and proliferating cells of the intestine.

The Sequences 41–73 and/or 74–106 and/or 298–380 and/or 476–506 and/or 519–556 and/or 1273–1480 and/or 1596–1614 and/or 1657–1658 and/or 1690 and/or 1696–1712 and/or 1751 and/or 1753–1754 and/or 1757 are useful for the treatment and/or prevention of hyperproliferative disorders, including but not limited to brain tumors, sarcomas, carcinomas and lymphomas, restenosis, hyperplasisa, pulmonary fibrosis, angiogenesis and psoriasis.

The Sequences 1278–1480 and/or 1491–1531 and/or 1582–1595 and/or 1615–1655 and/or 1691–1694 and/or 1697–1750 and/or 1759–1764 are useful for the treatment and/or prevention of diseases characterised by hyperfunction of the immune system and/or of inflammatory disorders and/or auto-immune disorders, including, but not limited to asthma (molecules according to the invention being applied by inhalation and/or by parenteral routes and/or orally), multiple sclerosis, inflammatory disorders of the intestine, including jejunitis, ileitis and/or colitis, as well as inflammatory disorders characterised by hyperproliferation and/or hyperfunction of cells of the eosinophilic lineage and/or glomerulonephritis and/or rejection of transplants.

The Sequences 476–506 and/or 1550–1581 and/or 1582–1595 and/or 1658–1689 and/or 1691–1694 and/or 1713–1752 are useful for the treatment and/or prevention of diseases associated with cell degeneration, including, but not limited to neurodegeneration, e.g. Alzheimer's diseases, Parkinson's, ischemic disorders, including myocardial ischemia and/or ischemia of the nervous system, including stroke.

A further aspect of the present invention is a medicament comprising an oligonucleotide according to the invention together with additives. The oligonucleotides of the invention can be used for the preparation of a medicament for the prevention or the treatment of neoplasm, hypoproliferation, hyperproliferation, degenerative diseases, neurodegenerative diseases, ischaemia, disorders of the immune system and/or infectious diseases and can be used for the analysis of gene function or drug target validation.

Molecules according to the invention can be used to study the function of target molecules and their encoded transcription and/or translation products, including RNA molecules and proteins. Downregulations of a protein or nucleic acid molecule using molecules according to the invention can be used to study the function of the molecule. It is also a feature of the invention that molecules according to the invention can be used to study whether modulation of the product has a desired effect, including therapeutic effects and to use this information to develop a different molecule, in order to modulate the function of the protein.

This includes, for example, drug target validation with a molecule according to the invention, in order to answer the question whether development of an agent capable of modulating the structure, function or expression of a potential target molecule, e. g. an agonist or antagonist of the target molecule has desired effect and may e. g. be of therapeutic or diagnostic use.

It is thus also a feature of the invention that molecules according to the invention can be used for drug target validation, including but not limited to studying whether modulation of a protein or nucleic acid molecule has a desired effect, including therapeutic effects and using this information to develop a compound, e. g. a therapeutic compound capable of modulating the structure, function or expression of the molecule the function of which was previously studied with molecules according to the invention.

EXAMPLE 1

Treatment of Peripheral Blood Mononuclear Cells with TGF-β1 Antisense Phosphorothioate Oligodeoxynucleotides:

Human peripheral blood mononuclear cells (PBMCs) produce transforming growth factor β1 (TGF-β1). The TGF-β1 produced by these cells negatively regulates immune cell proliferation in an autologous manner. This autologous negative regulation of immune cell proliferation could be reversed by antisense TGF-β1 molecules according to the invention, leading to stimulation of immune cell proliferation. In contrast to the molecules according to the invention, antisense molecules chosen conventionally, including that published by Hatzfeld et al. (1991) did not stimulate immune cell proliferation. Even more surprising, several sequences, chosen conventionally, even reduced immune cell proliferation.

Peripheral blood mononuclear cells (PBMCs) were isolated from venous blood of healthy donors by mixing with an equal volume of RPMI 1640 medium (Gibco) supplemented with 10% fetal calf serum and 1 mM L-glutamine, followed by layering onto Ficoll-Hypaque (Pharmacia) gradients and centrifugation at 400 g for 30 min. PBMCs were removed from the plasma-Ficoll interface and washed in the above medium. Cells (2×104 in 100 µl of medium) were plated into 96 well flat-bottom microtiter plates (Nunc) in serum supplemented complete medium. Cells were activated with 3 µg/ml phytohemagglutinin and incubated with either no oligodeoxynucleotide (untreated control cells) or with 8 µM of different antisense phosphorothioate oligodeoxynucleotides, complementary to different regions of the human TGF-β1 mRNA for 4 days. Cells were then stained with trypan blue to determine cell viability and counted in a Neubauer counting chamber.

Oligonucleotide sequences were either 33 sequences according to the invention, named sequences TGF-β1-1–TGF-1-33 (SEQ ID NOS: 41–73) or the TGF-β1 antisense sequence from Hatzfeld et al. (1991), J. Exp. Med., 174, pp. 925–929 or 39 other conventionally chosen antisense sequences complementary to human TGF-β1 nRNA, named N1–N39 (see FIG. 3) (SEQ ID NOS: 2–40).

Surprisingly the molecules according to the invention were much more effective than antisense TGF-β1 molecules that were chosen conventionally.

Sequences TGF-β1-1–TGF-β1-33 (SEQ ID NOS: 41–73) (see FIG. 3) enhanced lymphocyte proliferation to between 135 and 213% of untreated controls. In contrast, treatment with the antisense sequence from document Hatzfeld et al. reduced proliferation to 62.8%.

Cells treated with the conventionally chosen TGF-β1 antisense sequences N1–N39 (SEQ ID NOS: 2–40) surprisingly not only failed to increase lymphocyte proliferation, but several of these sequences even revealed a marked inhibition of cell proliferation to between 51.4% and 77% of controls (sequences N1–N14 (SEQ ID NOS: 2–15), N20 (SEQ ID NO: 21), N26 (SEQ ID NO: 27) and N30–N39 (SEQ ID NOS: 31–40). The antisense TGF-β1 sequences N15–N19, (SEQ ID NOS: 16–20) N21–N25 (SEQ ID NOS: 22–26), N28 (SEQ ID NO: 29) and N29 (SEQ ID NO: 30) showed neither significant enhancement nor significant inhibition of cell proliferation with values between 94% and 103%. Sequence N27 (SEQ ID NO: 28) showed slight toxicity with a reduction in cell proliferation to 88%.

Inhibition of cell proliferation by some of the TGF-β1 sequences suggests that they may not be merely ineffective, but also toxic. Analysis of the 26 sequences N1–N14 (SEQ ID NOS: 2–15), N20 (SEQ ID NO: 21), N26 (SEQ ID NO: 27) and N30–N39 (SEQ ID NOS: 31–40) revealed that 23 of them contained either 2 or more sequence motifs with three consecutive Gs (hereafter called GGG motif) or at least one motif with 4, 5, or 6 Gs (motifs GGGG, GGGGG, or GGGGGG). Analysis of the sequence from Hatzfeld et al., which also inhibited PBMC proliferation, surprisingly showed that it too contains a GGGGG plus a GGG motif. The 3 toxic sequences that contained neither 2 GGG motifs nor a motif of 4 or more consecutive Gs, i.e. sequences N8 (SEQ ID NO: 9), N26 (SEQ ID NO: 27), and N35 (SEQ ID NO: 36) were found have a base content with 11–13 G-bases per sequence.

In contrast to the sequences from Hatzfeld et al., N1–N14 (SEQ ID NOS: 2–15), N20 (SEQ ID NO: 21), N26 (SEQ ID NO: 27) and N30–N39 (SEQ ID NOS: 31–40) the sequences TGF-β1-1–TGF-β1-33 showed a G-content of maximally 6 G-bases, no combination of two GGG motifs within a single sequence and no GGGG, GGGGG or GGGGGG motif. Since the TGF-β1 mRNA contains more than 85 target regions for a GGG antisense motif and more than 34 target regions for a GGGG antisense motif, this finding in the sequences according to the invention was highly unlikely on a statistical basis.

The non-effective sequences N15–N19 (SEQ ID NOS: 16–20), N21–N25 (SEQ ID NOS: 22–26), N28 (SEQ ID NO: 29) and N29 (SEQ ID NO: 30) were found to contain a different base content from both the toxic and the effective sequences: They content of the bases A and T taken together (A/T-content) ranged from 14.3% to 28.5%. These sequences neither enhanced nor did they inhibit PBMC proliferation. Thus, they appeared to be neither effective nor toxic. In contrast to these non-effective sequences with an A/T content of 14.3%–28.5%, the effective sequences TGF-β1-1–TGF-β1-33 (SEQ ID NOS: 41–73) were found to have an A/T content of between 33%–71.4%.

A further difference between the sequences of the invention and two thirds of the other sequences was found with respect to non-specific protein binding: Sequences from document Hatzfeld et al. and N1–N14 (SEQ ID NOS: 2–15), N20 (SEQ ID NO: 21), N26 (SEQ ID NO: 27) and N30–N39 (SEQ ID NOS: 31–40) were found to show markedly enhanced non-specific protein binding compared to the sequences of the invention.

Sequences from Hatzfeld et al. (H) and N1–N39 (SEQ ID NOS: 2–40) are shown in FIG. 3 as well as TGF-β1 antisense sequences according to the invention.

The finding that, while the sequences TGF-β1-1–TGF-β1-33 (SEQ ID NOS: 41–73) stimulated proliferation of PBMC immune cells, the sequence from Hatzfeld et al. and sequences N1–N39 (SEQ ID NOS: 2–40) where either non-effective with little alteration in PBMC proliferation or had toxic effects and inhibited PBMC proliferation was extended to further antisense sequences both of TGF-β2 and other genes as detailed in the following examples 2–7.

The sequences of the oligonucleotides related with TGF-β1 are listed in FIG. 3 for the sake of ease of readability.

For certain applications, including, but not limited to application in dividing cells, including tumor cells, nucleic acid or functional or structural analogs or effective derivatives thereof according to the invention were coupled to folic acid, either at one of the carboxy-groups or at one of the nitrogen atoms of the folic acid.

Furthermore, for certain applications, nucleic acid or functional or structural analogs or effective derivatives thereof according to the invention are mixed with and/or coupled to hormones, steroid hormones such as oestrogen, progesterone, corticosteroids, mineralocorticoids, androgens, phospholipids, peptides, proteoglycans, glycolipids and derivatives therefrom. Preferably, a coupling occurs at $R^2$ and/or $R^3$ of FIGS. 1 and 2.

EXAMPLE 2 p53 Antisense Nucleic Acids (FIG. 3 Shows the Respective Oligonucleotides)

p53 is a tumor suppressor gene that negatively regulates cell proliferation. Certain mutations in the gene can alter the function of p53 in such a way that it becomes an oncogene. The effects of p53 antisense oligodeoxynucleotides on cells containing wild type p53 was analyzed and subsequently also the effect of these sequences on cells with mutated p53.

In cells with wild type p53 effective antisense nucleic acids will lead to downregulation of the wild type p53 protein and thus to enhanced proliferation of the treated cells Molecules according to the invention are named p53-1–p53-33 (SEQ ID NOS: 74–106). Noneffective p53 antisense sequences were named p53-N-1–p53-N-18. Toxic sequences, which inhibited proliferation instead of enhancing it as do effective p53 antisense sequences were named p53-T-1–p53-T-29 (SEQ ID NOS: 125–153).

Normal human fibroblasts were grown in RPMI medium supplemented with 5% fetal calf serum (FCS) and 2500 cell/well were plated into 96-well microtiter plates. Antisense phosphorothioate oligonucleotides were added at 2 µM concentration after 2 h.

Two assays to determine cell proliferation were performed:

To determine 3H-thymidine incorporation, cells were incubated before harvesting with 0.15 µCi 3H-thymidine/well for 6 h. Cells were lysed by freezing, spotted onto glass filters and the amount of incorporated tritium was determined by liquid scintillation counting.

To determine cell number, cells were stained with trypan blue and counted in a Neubauer counting chamber.

Surprisingly, only treatment of cells with antisense sequences according to the invention (p53-1–p53-33) (SEQ ID NOS: 74–105) resulted in an increase in thymidine incorporation to between 3- and 9-fold.

In contrast, treatment with noneffective sequences (p53-N-1–p53-N-18) (SEQ ID NOS: 107–124) did not result in significant alterations in thymidine incorporation.

Furthermore, treatment with toxic antisense p53 sequences (p53-T-1–p53-T-29) (SEQ ID NOS: 125–153) resulted in a decrease in proliferation instead of an increase.

In summary, the 33 antisense sequences according to the invention resulted in effective downregulation of negative growth control by p53 and increased cell proliferation, while the 47 other antisense sequences had either no significant effect on cell proliferation or even suppressed cell proliferation.

EXAMPLE 3
junB Antisense Nucleic Acids (FIG. 3 Shows the Respective Oligonucleotides)

junB and junD, two genes encoding transcription factors of the jun gene family are negative regulators of cell growth, like p53. The effects of different junB and junD antisense oligodeoxynucleotides was analyzed.

Effective junB and JunD antisense nucleic acids will lead to downregulation of the JunB an JunD proteins respectively and thus to enhanced proliferation of the treated cells. Antisense molecules according to the invention are named JunB-1–JunB-19 (SEQ ID NOS: 154–172) and JunD-1–JunD-31 (SEQ ID NOS: 173–203). Noneffective junB antisense sequences were named JunB-N-1–JunB-N-57 (SEQ ID NOS: 204–206). Toxic sequences, which inhibited proliferation instead of enhancing it were named JunB-T-1–JunB-T-20 (SEQ ID NOS: 261–280) and JunD-T-1–JunD-T-17 (SEQ ID NOS: 281–297).

Normal human fibroblasts were grown in RPMI medium supplemented with 5t fetal calf serum (FCS) and 2500 cell/well were plated into 96-well microtiter plates. Antisense phosphorothioate oligonucleotides were added at 2 $\mu$M concentration after 2 h.

Two assays to determine cell proliferation were performed:

To determine 3H-thymidine incorporation, cells were incubated before harvesting with 0.15 $\mu$Ci 3H-thymidine/well for 6 h. Cells were lysed by freezing, spotted onto glass filters and the amount of incorporated tritium was determined by liquid scintillation counting.

To determine cell number, cells were stained with trypan blue and counted in a Neubauer counting chamber.

Surprisingly, again only treatment of cells with antisense sequences according to the invention (JunB-1–JunB-19 (SEQ ID NOS: 154–172) and JunD1–JunD31 (SEQ ID NOS: 173–203)) resulted in an increase in thymidine incorporation to between 2- and 7-fold.

In contrast, treatment with noneffective sequences (JunB-N-1–JunB-N-57) (SEQ ID NOS: 204–260), did not result in significant alterations in thymidine incorporation.

Furthermore, treatment with toxic antisense junB or JunD sequences (JunB-T-1–JunB-T-20 (SEQ ID NOS: 261–280) and JunD-T-1–JunD-T-17) (SEQ ID NOS: 281–297) resulted in a decrease in proliferation instead of an increase.

In summary, the 50 antisense sequences according to the invention resulted in effective downregulation of negative growth control by JunB and JunD, while the 94 other antisense sequences had either no significant effect on cell proliferation or were even toxic.

EXAMPLE 4
(FIG. 3 Shows the Respective Oligonucleotides)

erbB-2, is a transmembrane molecule with an intracellular tyrosine kinase activity that is amplified and/or overexpressed by carcinoma cells in a variety of neoplasms including breast cancer, lung cancer, oesophageal and gastric cancer, bile duct carcinoma, bladder cancer, pancreatic cancer and ovarian cancer.

In several of these tumors, an amplification and overexpression of the c-erbB-2 gene in the tumor tissue has been shown to correlate with a poor clinical prognosis. Overexpression of p185erbB-2 in non-small-cell lung carcinoma has been shown to impart resistance to a number of chemotherapeutic agents.

Effective erbB-2 antisense nucleic acids will lead to downregulation of the erbB-2 protein and in overexpressing tumor cell lines will lead to reduced cell proliferation of the treated cells. Antisense molecules according to the invention are named erbB-2-1–erbB-2-83 (SEQ ID NOS: 298–380). Noneffective erbB-2 antisense sequences were named erbB-2-N-1–erbB-2-N-95 (SEQ ID NOS: 381–475).

erbB-2 overexpressing SK-Br-3 human mammary carcinoma cells were grown in RPMI medium supplemented with 5% fetal calf serum (FCS) and 2500 cell/well were plated into 96-well microtiter plates. Antisense phosphorothioate oligonucleotides were added at 2 $\mu$M concentration after 2 h.

To determine erbB-2 protein expression cells were harvested with a cell scraper and subjected to ELISA protein determination.

Only treatment of cells with antisense sequences according to the invention (erbB-2-1–erbB-2-83) (SEQ ID NOS: 298–380) resulted in a significant reduction in erbB-2 protein expression by 40–95%.

In contrast, treatment with noneffeective sequences (erbB-2-N-1–erbB-2-N-95) (SEQ ID NOS: 381–475) did not result in significant alterations in erbB-2 protein expression.

To determine cell number, cells were stained with trypan blue and counted in a Neubauer counting chamber.

Only treatment of cells with antisense sequences according to the invention (erbB-2-1–erbB-2-83) (SEQ ID NOS: 298–380) resulted in a reduction in cell number by 35–70%.

In contrast, treatment with noneffective sequences (erbB-2-N-1–erbB-2-N-95) (SEQ ID NOS: 381–475) did not result in significant alterations in cell proliferation.

erbB-2 antisense sequences were shown in FIGS. 3–8 to 3–11

EXAMPLE 5
(FIG. 3 Shows the Respective Oligonucleotides)

The c-fos gene encodes an immediate early gene type transcription factor. Effective c-fos antisense nucleic acids will lead to downregulation of the c-Fos protein.

Antisense molecules according to the invention are named c-fos-1–c-fos-31 (SEQ ID NOS: 476–506). Noneffective c-fos antisense sequences were named c-fos-N-1–c-fos-N-12 (SEQ ID NOS: 507–518).

Normal human fibroblasts were grown in RPMI medium supplemented with 5% fetal calf serum (FCS) and 2500 cell/well were plated into 96-well microtiter plates. Antisense phosphorothioate oligonucleotides were added at 2 $\mu$M concentration after 2 h.

Expression of the c-Fos protein was determined by ELISA in cell lysates.

Only treatment of cells with antisene sequences according to the invention (c-fos-1–c-fos-31) (SEQ ID NOS: 476–506) resulted in a significant reduction in c-fos protein expression by 45–95%.

In contrast, treatment with noneffective sequences (c-fos-N-1–c-fos-N-12) (SEQ ID NOS: 507–518) did not result in significant alterations in c-Fos protein expression.

EXAMPLE 6
(FIG. 3 Shows the Respective Oligonucleotides)

TGF-$\beta$12, like TGF-$\beta$1 is a member of the transforming growth factor-$\beta$ family of cytokines.

Overexpression of TGF-$\beta$1 and TGF-$\beta$2 is linked to malignant progression, immunosuppression and escape of the tumors from surveillance by the immune system.

Effective TGF-β2 antisense nucleic acids will lead to downregulation of the TGF-β2 growth factor.

Antisense molecules according to the invention are named TGF-β2-1–TGF-β2-38 (SEQ ID NOS: 519–556. Noneffective TGF-β2 antisense sequences were named TGF-β2-N-1–TGF-β2-N-40) (SEQ ID NOS: 557–596).

TGF-B2 overexpressing tumor cells were grown in RPMI medium supplemented with 5% fetal calf serum (FCS) and 2500 cell/well were plated into 96-well microtiter plates. Antisense phosphorothioate oligonucleotides were added at 2 µM concentration after 2 h.

TGF-β2 protein expression was determined by ELISA, both in the supernatant and in cell lysates.

Only treatment of cells with antisense sequences according to the invention (TGF-β2-1–TGF-β2-38)) (SEQ ID NOS: 519–556) resulted in a significant reduction in TGF-β2 protein expression by 35–80%.

In contrast, treatment with noneffective sequences (TGF-2-N-1–TGF-β2-N-40)) (SEQ ID NOS: 557–596) did not result in significant alterations in TGF-β2 protein expression.

EXAMPLE 7
(FIG. 3 Shows the Respective Oligonucleotides)

rb Antisense Nucleic Acids rb is a tumor suppressor gene that negatively regulates cell proliferation. The effects of rb antisense oligodeoxynucleotides on cells containing wild type rb was analyzed.

In cells with wild type rb effective antisense nucleic acids will lead to downregulation of the wild type rb protein and thus to enhanced proliferation of the treated cells. Molecules according to the invention are named rb-1–rb-45 (SEQ ID NOS: 597–641). Noneffective rb antisense sequences were named -1–rb-N-168) (SEQ ID NOS: 642–809). Toxic sequences, which inhibited proliferation instead of enhancing it as do effective rb antisense sequences were named rb-T-1–rb-T-16) (SEQ ID NOS: 810–825).

Normal human fibroblasts were grown in RPMI medium supplemented with 5% fetal calf serum (FCS) and 2500 cell/well were plated into 96-well microtiter plates. Antisense phosphorothioate oligonucleotides were added at 2 µM concentration after 2 h.

Two assays to determine cell proliferation were performed:

To determine 3H-thymidine incorporation, cells were incubated before harvesting with 0.15 µCi 3H-thymidine/well for 6 h. Cells were lysed by freezing, spotted onto glass filters and the amount of incorporated tritium was determined by liquid scintillation counting.

To determine cell number, cells were stained with trypan blue and counted in a Neubauer counting chamber.

Surprisingly, only treatment of cells with antisense sequences according to the invention (rb-1–rb-45) (SEQ ID NOS: 597–641) resulted in an increase in thymidine incorporation to between 2- and 6-fold.

In contrast, treatment with noneffective sequences (rb-N-1–rb-N-168) (SEQ ID NOS: 642–809) did not result in significant alterations in thymidine incorporation.

Furthermore, treatment with toxic antisense rb sequences (rb-T-1–rb-T-16) (SEQ ID NOS: 810–825) resulted in a decrease in proliferation instead of an increase.

In summary, the 45 antisense sequences according to the invention resulted in effective downregulation of negative growth control by rb and increased cell proliferation, while the 184 other antisense sequences had either no significant effect on cell proliferation or even suppressed cell proliferation.

EXAMPLE 8

Oligonucleotide sequences according to the invention were synthesized with various different backbone modifications:

Exemplary results are given below.

For the sequence erbB-2–42: CATCTGGAAACTTCCAGATG (SEQ ID NO: 339)

the following chemical modifications were tested in erbB-2 overexpressing carcinoma cells:

1. S-ODN erbB-2-42 (i.e. all backbone linkages were thioate modifications).

C-pS-A-pS-T-pS-C-pS-T-pS-G-pS-G-pS-A-pS-A-pS-A-pS-C-pS-T-pS-T-pS-C-pS-C-pS-A-pS-G-pS-A-pS-T-pS-G

2. Me-ODN/S-ODN/Me-ODN erbB-2-42 (i.e. Linkages at the 5' and 3' end were methylphosphonate linkages while linkages in the middle were thioate modifications as follows):

C-pMe-A-pMe-T-pS-C-pS-T-pS-G-pS-G-pS-A-pS-A-pS-A-pS-C-pS-T-pS-T-pS-C-pS-C-pS-A-pS-G-pS-A-pMe-T-pMe-G or

C-pMe-A-pMe-T-pMe-C-pS-T-pS-G-pS-G-pS-A-pS-A-pS-A-pS-C-pS-T-pS-T-pS-C-pS-C-pS-A-pS-G-pMe-A-pMe-T-pMe-G or

C-pMe-A-pMe-T-pMe-C-pMe-T-pS-G-pS-G-pS-A-pS-A-pS-A-pS-C-pS-T-pS-T-pS-C-pS-C-pS-A-pMe-G-pMe-A-pMe-T-pMe-G or

C-pMe-A-pMe-T-pMe-C-pMe-T-pMe-G-pMe-G-pS-A-pS-A-pS-A-pS-C-pS-T-pS-T-pS-C-pMe-C-pMe-A-pMe-G-pMe-A-pMe-T-pMe-G

3. Me-ODN/S-ODN erbB-2-42 (i.e. Linkages at the 5' end were methylphosphonate linkages while linkages at the 3' were thioate modifications as follows):

C-pMe-A-pMe-T-pMe-C-pMe-T-pMe-G-pMe-G-pMe-A-pMe-A-pMe-A-pS-C-pS-T-pS-T-pS-C-pS-C-pS-A-pS-G-pS-A-pS-T-pS-G

4. S-ODN/Me-ODN erbB-2-42 (i.e. Linkages at the 5' end were methylphosphonate linkages while linkages at the 3' were thioate modifications as follows):

C-pS-A-pS-T-pS-C-pS-T-pS-G-pS-G-pS-A-pS-A-pS-A-pMe-C-pMe-T-pMe-T-pMe-C-pMe-C-pMe-A-pMe-G-pMe-A-pMe-T-pMe-G

5. Me-ODN erbB-2-42 (i.e. linkages methylphosphonate linkages):

C-pMe-A-pMe-T-pMe-C-pMe-T-pMe-G-pMe-G-pMe-A-pMe-A-pMe-A-C-pMe-T-pMe-T-pMe-C-pMe-C-pMe-A-pMe-G-pMe-A-pMe-T-pMe-G 6. pN/S-ODN/pN erbB-2-42 (i.e. Linkages at the 5' and 3' end were phosphoramidate linkages while linkages in the middle were thioate modifications as follows):

C-pN-A-pN-T-pS-C-pS-T-pS-G-pS-G-pS-A-pS-A-pS-A-pS-C-pS-T-pS-T-pS-C-pS-C-pS-A-pS-G-pS-A-pN-T-pN-G or

C-pN-A-pN-T-pN-C-pS-T-pS-G-pS-G-pS-A-pS-A-pS-A-pS-C-pS-T-pS-T-pS-C-pS-C-pS-A-pS-G-pN-A-pN-T-pN-G or

C-pN-A-pN-T-pN-C-pN-T-pS-G-pS-G-pS-A-pS-A-pS-A-pS-C-pS-T-pS-T-pS-C-pS-C-pS-A-pN-G-pN-A-pN-T-pN-G or

C-pN-A-pN-T-pN-C-pN-T-pN-G-pN-G-pS-A-pS-A-pS-A-pS-C-pS-T-pS-T-pS-C-pN-C-pN-A-pN-G-pN-A-pN-T-pN-G where
pS stands for substitution of one of the non-bridging oxygen atoms of the backbone linkage with a sulfur atom, while pMe stands for substitution of one of the non-bridging oxygen atoms of the backbone linkage with a methyl group. pN stands for a N3'->P5' phosphoramidate linkage.
Also a combination of linkages (N-pS-N-pO-N-pO-N)$_n$-[pS-N]$_m$ wherein n=1–10 and m=0–6 where N stand for any nucleotide or structural or functional analog or derivative thereof.

While the Me-ODN backbone modification strongly reduced the erbB-2 activity of the erbB-2-42 (SEQ ID NO: 339) sequence to less than 20%, backbone modifications 1.–4. had strong erbB-2 inhibitory capacity with an inhibition of erbB-2 protein expression by between 78% and 89% at 2 µM concentration at 48 h after the beginning of treatment of overexpressing carcinoma cells.

While the pure S-ODN had the highest suppression capacity with 89%, the Me-ODN/S-ODN/Me-ODN as well as the Me-ODN/S-ODN and S-ODN/Me-ODN and pN/S-ODN/pN, displayed reduced protein binding and when tested for complement activation, showed reduced complement activation. These characteristics are advantageous for certain applications e.g. intravenous systemic application in vivo.

EXAMPLE 9

Similar effects were obtained when testing other sequences according to the invention with the above backbone modifications.

Inhibition of TGF-beta-1 gene expression with the effective sequences for TGF-beta-1 according to the invention was highest with S-ODN and the Me-ODN/S-ODN/Me-ODN backbone modifications and lowest with the Me-ODN modification, while protein binding and complement activation were reduced in sequences containing Me-ODN linkages.

EXAMPLE 10

Surprisingly, effectivity of sequences according to the invention was significantly improved in various cell types by coupling nucleic acids according to the invention to folic acid:

erbB-2 inhibitory capacity which was relatively low after 24 h compared to 48 h with an inhibition of erbB-2 protein synthesis by 24–37% was markedly increased by coupling sequences according to the invention to folic acid to 48–62% at 2 µM concentration 24 h after the beginning of treatment of overexpressing carcinoma cells.

Similar effects were achieved by coupling sequences according to the invention to folic acid derivatives including aminopterin and amethopterin.

EXAMPLE 11

Surprisingly, effectivity of sequences according to the invention was strongly improved by coupling oligonucleotides according to the invention to cortisol:

Cellular uptake and inhibitory capacity of sequences according to the invention including sequences for TGF-beta-1, TGF-beta-2, c-fos, p53, erbB-2, rb, c-fos, junB, junD, c-jun, MIP-1 alpha, JAK-2, bcl-2 and were markedly increased by coupling cortisol either to the 3' or 5' hydroxyl groups of oligonucleotide sequences according to the invention.

EXAMPLE 12

Effectivity of sequences according to the invention was also strongly improved in various cell types by coupling nucleic acids according to the invention to or mixing them with other steroid hormones and their derivatives, including oestrogens, anti-oestrogens, prednisone, prednisolone, androgens, anti-androgens, gestagenes like progesterone as well as peptides, proteoglycans, glycolipids, phospholipids and derivatives therefrom.

Androgens, particularly androstendion and testosterone, as well as anti-androgens, including cyproteronacetate, flutamide, anandrone, linked to the nucleic acids increased effectiveness of the molecules in various cell types including prostatic carcinoma cells.

Oestrogens, anti-oestrogens and their derivatives, including fosfestrol, toremifen, ethinyloestradiole, diethylstilboestole and the oestradiole derivatives oestradiol-benzoate, oestradiol-valerinate and oestradiol-undecylate, as well as progesterone and its derivatives, including medroxyprogestroneacetate and megestrolacetate linked to the oligonucleotides strongly enhanced activity of the molecules according to the invention in various cell types including mammary carcinoma cells.

SEQUENCE LISTING (1764 sequences)

SEQ ID NO: 1 - DNA, 21 bp, Artificial Sequence
  Description of Artificial Sequence: antisense oligonucleotide
cccggagggcggcatggggga

SEQ ID NO: 2 - DNA, 18 bp, Artificial Sequence
  Description of Artificial Sequence: antisense oligonucleotide
cctcagggagaagggcgc

SEQ ID NO: 3 - DNA, 18 bp, Artificial Sequence
  Description of Artificial Sequence: antisense oligonucleotide
gtaggagggcctcgaggg

SEQ ID NO: 4 - DNA, 18 bp, Artificial Sequence
  Description of Artificial Sequence: antisense oligonucleotide
ctgcaggggctgggggtc

SEQ ID NO: 5 - DNA, 18 bp, Artificial Sequence
  Description of Artificial Sequence: antisense oligonucleotide
agggctggtgtggtgggg

SEQ ID NO: 6 - DNA, 18 bp, Artificial Sequence
  Description of Artificial Sequence: antisense oligonucleotide
ggcatgggggaggcggcg

SEQ ID NO: 7 - DNA, 18 bp, Artificial Sequence
  Description of Artificial Sequence: antisense oligonucleotide
ccggagggcggcatgggg

SEQ ID NO: 8 - DNA, 18 bp, Artificial Sequence
  Description of Artificial Sequence: antisense oligonucleotide
ggggggctggcgagccgc

SEQ ID NO: 9 - DNA, 23 bp, Artificial Sequence
  Description of Artificial Sequence: antisense oligonucleotide
ggacaggatctggccgcggatgg

SEQ ID NO: 10 - DNA, 18 bp, Artificial Sequence
  Description of Artificial Sequence: antisense oligonucleotide
ccccctggctcggggggc

SEQ ID NO: 11 - DNA, 18 bp, Artificial Sequence
  Description of Artificial Sequence: antisense oligonucleotide
gggccgggcggcacctcc

SEQ ID NO: 12 - DNA, 18 bp, Artificial Sequence
  Description of Artificial Sequence: antisense oligonucleotide
gggcagcgggccgggcgg

SEQ ID NO: 13 - DNA, 18 bp, Artificial Sequence
  Description of Artificial Sequence: antisense oligonucleotide
acggcctcgggcagcggg

SEQ ID NO: 14 - DNA, 18 bp, Artificial Sequence
  Description of Artificial Sequence: antisense oligonucleotide
gggtgctgttgtacaggg

SEQ ID NO: 15 - DNA, 24 bp, Artificial Sequence
  Description of Artificial Sequence: antisense oligonucleotide
gggtttccaccattagcacgcggg

SEQ ID NO: 16 - DNA, 14 bp, Artificial Sequence
  Description of Artificial Sequence: antisense oligonucleotide
tcatagatttcgtt

SEQ ID NO: 17 - DNA, 13 bp, Artificial Sequence
  Description of Artificial Sequence: antisense oligonucleotide
ttgtcatagattt

SEQ ID NO: 18 - DNA, 15 bp, Artificial Sequence
  Description of Artificial Sequence: antisense oligonucleotide
aagaacatatatatg

SEQ ID NO: 19 - DNA, 14 bp, Artificial Sequence
  Description of Artificial Sequence: antisense oligonucleotide
aagaacatatatat

SEQ ID NO: 20 - DNA, 16 bp, Artificial Sequence
  Description of Artificial Sequence: antisense oligonucleotide
ttgaagaacatatata

SEQ ID NO: 21 - DNA, 18 bp, Artificial Sequence
  Description of Artificial Sequence: antisense oligonucleotide
ccgggagagcaacacggg

SEQ ID NO: 22 - DNA, 13 bp, Artificial Sequence
  Description of Artificial Sequence: antisense oligonucleotide
acttttaacttga

SEQ ID NO: 23 - DNA, 15 bp, Artificial Sequence
  Description of Artificial Sequence: antisense oligonucleotide
attgttgctgtattt

SEQ ID NO: 24 - DNA, 14 bp, Artificial Sequence
  Description of Artificial Sequence: antisense oligonucleotide
attgttgctgtatt

SEQ ID NO: 25 - DNA, 15 bp, Artificial Sequence
  Description of Artificial Sequence: antisense oligonucleotide
aattgttgctgtatt

SEQ ID NO: 26 - DNA, 14 bp, Artificial Sequence
  Description of Artificial Sequence: antisense oligonucleotide
aattgttgctgtat

SEQ ID NO: 27 - DNA, 27 bp, Artificial Sequence
  Description of Artificial Sequence: antisense oligonucleotide
ggcgagtcgctgggtgccagcagccgg

SEQ ID NO: 28 - DNA, 14 bp, Artificial Sequence
  Description of Artificial Sequence: antisense oligonucleotide
ggcgagtcgctggg

SEQ ID NO: 29 - DNA, 14 bp, Artificial Sequence
  Description of Artificial Sequence: antisense oligonucleotide
acatcaaaagataa

SEQ ID NO: 30 - DNA, 14 bp, Artificial Sequence
  Description of Artificial Sequence: antisense oligonucleotide
tgacatcaaaagat

SEQ ID NO: 31 - DNA, 18 bp, Artificial Sequence
  Description of Artificial Sequence: antisense oligonucleotide
gggccctctccagcgggg

SEQ ID NO: 32 - DNA, 18 bp, Artificial Sequence
  Description of Artificial Sequence: antisense oligonucleotide
gggctcggcggtgccggg

SEQ ID NO: 33 - DNA, 18 bp, Artificial Sequence
  Description of Artificial Sequence: antisense oligonucleotide
ggggcagggcccgaggca

SEQ ID NO: 34 - DNA, 18 bp, Artificial Sequence
  Description of Artificial Sequence: antisense oligonucleotide
ggctccaaatgtaggggc

SEQ ID NO: 35 - DNA, 24 bp, Artificial Sequence
  Description of Artificial Sequence: antisense oligonucleotide
cgggttatgctggttgtacagggc

SEQ ID NO: 36 - DNA, 22 bp, Artificial Sequence
  Description of Artificial Sequence: antisense oligonucleotide
cggcgccgccgaggcgcccggg

SEQ ID NO: 37 - DNA, 16 bp, Artificial Sequence
  Description of Artificial Sequence: antisense oligonucleotide
ggggcggggcgggacc

SEQ ID NO: 38 - DNA, 18 bp, Artificial Sequence
  Description of Artificial Sequence: antisense oligonucleotide
gggcggggcggggcgggg

SEQ ID NO: 39 - DNA, 18 bp, Artificial Sequence
  Description of Artificial Sequence: antisense oligonucleotide
gggcggggtggggccggg

SEQ ID NO: 40 - DNA, 22 bp, Artificial Sequence
  Description of Artificial Sequence: antisense oligonucleotide
gggcaaggcagcgggggcgggg

SEQ ID NO: 41 - DNA, 14 bp, Artificial Sequence
  Description of Artificial Sequence: antisense oligonucleotide
cggtagcagcagcg

SEQ ID NO: 42 - DNA, 14 bp, Artificial Sequence
  Description of Artificial Sequence: antisense oligonucleotide
ccagtagccacagc

SEQ ID NO: 43 - DNA, 15 bp, Artificial Sequence
  Description of Artificial Sequence: antisense oligonucleotide
gcaggtggatagtcc

SEQ ID NO: 44 - DNA, 15 bp, Artificial Sequence
  Description of Artificial Sequence: antisense oligonucleotide
cttgcaggtggatag

SEQ ID NO: 45 - DNA, 15 bp, Artificial Sequence
  Description of Artificial Sequence: antisense oligonucleotide
cgatagtcttgcagg

SEQ ID NO: 46 - DNA, 18 bp, Artificial Sequence
  Description of Artificial Sequence: antisense oligonucleotide
ccatgtcgatagtcttgc

SEQ ID NO: 47 - DNA, 15 bp, Artificial Sequence
  Description of Artificial Sequence: antisense oligonucleotide
ctcgatgcgcttccg

SEQ ID NO: 48 - DNA, 15 bp, Artificial Sequence
  Description of Artificial Sequence: antisense oligonucleotide
cctcgatgcgcttcc

SEQ ID NO: 49 - DNA, 15 bp, Artificial Sequence
  Description of Artificial Sequence: antisense oligonucleotide
ggatggcctcgatgc

SEQ ID NO: 50 - DNA, 15 bp, Artificial Sequence
  Description of Artificial Sequence: antisense oligonucleotide
ggacaggatctggcc

SEQ ID NO: 51 - DNA, 15 bp, Artificial Sequence
  Description of Artificial Sequence: antisense oligonucleotide
cgcagcttggacagg

SEQ ID NO: 52 - DNA, 14 bp, Artificial Sequence
  Description of Artificial Sequence: antisense oligonucleotide
gagccgcagcttgg

SEQ ID NO: 53 - DNA, 14 bp, Artificial Sequence
  Description of Artificial Sequence: antisense oligonucleotide
cgagccgcagcttg

SEQ ID NO: 54 - DNA, 14 bp, Artificial Sequence
  Description of Artificial Sequence: antisense oligonucleotide
acctccccctggct

SEQ ID NO: 55 - DNA, 14 bp, Artificial Sequence
  Description of Artificial Sequence: antisense oligonucleotide
ccaccattagcacg

SEQ ID NO: 56 - DNA, 18 bp, Artificial Sequence
  Description of Artificial Sequence: antisense oligonucleotide
gaacttgtcatagatttc

SEQ ID NO: 57 - DNA, 16 bp, Artificial Sequence
  Description of Artificial Sequence: antisense oligonucleotide
gctgtgtgtactctgc

SEQ ID NO: 58 - DNA, 14 bp, Artificial Sequence
  Description of Artificial Sequence: antisense oligonucleotide
gctccacgtgctgc

SEQ ID NO: 59 - DNA, 18 bp, Artificial Sequence
  Description of Artificial Sequence: antisense oligonucleotide
gaattgttgctgtatttc

SEQ ID NO: 60 - DNA, 15 bp, Artificial Sequence
  Description of Artificial Sequence: antisense oligonucleotide
gccaggaattgttgc

SEQ ID NO: 61 - DNA, 18 bp, Artificial Sequence
  Description of Artificial Sequence: antisense oligonucleotide
gtgacatcaaaagataac

SEQ ID NO: 62 - DNA, 15 bp, Artificial Sequence
  Description of Artificial Sequence: antisense oligonucleotide
ggctcaaccactgcc

SEQ ID NO: 63 - DNA, 14 bp, Artificial Sequence
  Description of Artificial Sequence: antisense oligonucleotide
gctgtcacaggagc

SEQ ID NO: 64 - DNA, 14 bp, Artificial Sequence
  Description of Artificial Sequence: antisense oligonucleotide
cctgctgtcacagg

SEQ ID NO: 65 - DNA, 18 bp, Artificial Sequence
  Description of Artificial Sequence: antisense oligonucleotide
gcagtgtgttatccctgc

SEQ ID NO: 66 - DNA, 15 bp, Artificial Sequence
  Description of Artificial Sequence: antisense oligonucleotide
gcagtgtgttatccc

SEQ ID NO: 67 - DNA, 14 bp, Artificial Sequence
  Description of Artificial Sequence: antisense oligonucleotide
ccaggtcacctcgg

SEQ ID NO: 68 - DNA, 15 bp, Artificial Sequence
  Description of Artificial Sequence: antisense oligonucleotide
gccatgaatggtggc

SEQ ID NO: 69 - DNA, 14 bp, Artificial Sequence
  Description of Artificial Sequence: antisense oligonucleotide
gccatgaatggtgg

SEQ ID NO: 70 - DNA, 14 bp, Artificial Sequence
  Description of Artificial Sequence: antisense oligonucleotide
ccatgagaagcagg

SEQ ID NO: 71 - DNA, 17 bp, Artificial Sequence
  Description of Artificial Sequence: antisense oligonucleotide
ggaagtcaatgtacagc

SEQ ID NO: 72 - DNA, 18 bp, Artificial Sequence
  Description of Artificial Sequence: antisense oligonucleotide
ccacgtagtacacgatgg

SEQ ID NO: 73 - DNA, 14 bp, Artificial Sequence
  Description of Artificial Sequence: antisense oligonucleotide
gcacttgcaggagc

SEQ ID NO: 74 - DNA, 14 bp, Artificial Sequence
  Description of Artificial Sequence: antisense oligonucleotide
ccatggcagtgacc

SEQ ID NO: 75 - DNA, 14 bp, Artificial Sequence
  Description of Artificial Sequence: antisense oligonucleotide
ggctcctccatggc

SEQ ID NO: 76 - DNA, 16 bp, Artificial Sequence
  Description of Artificial Sequence: antisense oligonucleotide
gctaggatctgactgc

SEQ ID NO: 77 - DNA, 14 bp, Artificial Sequence
  Description of Artificial Sequence: antisense oligonucleotide
cctgactcagaggg

SEQ ID NO: 78 - DNA, 17 bp, Artificial Sequence
  Description of Artificial Sequence: antisense oligonucleotide
ggtctgaaaatgtttcc

SEQ ID NO: 79 - DNA, 16 bp, Artificial Sequence
  Description of Artificial Sequence: antisense oligonucleotide
ccattgcttgggacgg

SEQ ID NO: 80 - DNA, 14 bp, Artificial Sequence
  Description of Artificial Sequence: antisense oligonucleotide
gcatcaaatcatcc

SEQ ID NO: 81 - DNA, 16 bp, Artificial Sequence
  Description of Artificial Sequence: antisense oligonucleotide
ccattgttcaatatcg

SEQ ID NO: 82 - DNA, 15 bp, Artificial Sequence
  Description of Artificial Sequence: antisense oligonucleotide
ggtcttcagtgaacc

SEQ ID NO: 83 - DNA, 17 bp, Artificial Sequence
  Description of Artificial Sequence: antisense oligonucleotide
ggagcttcatctggacc

SEQ ID NO: 84 - DNA, 15 bp, Artificial Sequence
  Description of Artificial Sequence: antisense oligonucleotide
cctctggcattctgg

SEQ ID NO: 85 - DNA, 14 bp, Artificial Sequence
  Description of Artificial Sequence: antisense oligonucleotide
agggacagaagatg

SEQ ID NO: 86 - DNA, 14 bp, Artificial Sequence
  Description of Artificial Sequence: antisense oligonucleotide
gttttctgggaagg

SEQ ID NO: 87 - DNA, 14 bp, Artificial Sequence
  Description of Artificial Sequence: antisense oligonucleotide
ggttttctgggaag

SEQ ID NO: 88 - DNA, 15 bp, Artificial Sequence
  Description of Artificial Sequence: antisense oligonucleotide
aggttttctgggaag

SEQ ID NO: 89 - DNA, 14 bp, Artificial Sequence
  Description of Artificial Sequence: antisense oligonucleotide
gtaggttttctggg

SEQ ID NO: 90 - DNA, 14 bp, Artificial Sequence
  Description of Artificial Sequence: antisense oligonucleotide
ggtaggttttctgg

SEQ ID NO: 91 - DNA, 17 bp, Artificial Sequence
  Description of Artificial Sequence: antisense oligonucleotide
ccagaatgcaagaagcc

SEQ ID NO: 92 - DNA, 15 bp, Artificial Sequence
  Description of Artificial Sequence: antisense oligonucleotide
gctgtcccagaatgc

SEQ ID NO: 93 - DNA, 18 bp, Artificial Sequence
  Description of Artificial Sequence: antisense oligonucleotide
gcaagtcacagacttggc

SEQ ID NO: 94 - DNA, 15 bp, Artificial Sequence
  Description of Artificial Sequence: antisense oligonucleotide
ccacagctgcacagg

SEQ ID NO: 95 - DNA, 15 bp, Artificial Sequence
  Description of Artificial Sequence: antisense oligonucleotide
ggtgtggaatcaacc

SEQ ID NO: 96 - DNA, 14 bp, Artificial Sequence
  Description of Artificial Sequence: antisense oligonucleotide
gtcatgtgctgtga

SEQ ID NO: 97 - DNA, 16 bp, Artificial Sequence
  Description of Artificial Sequence: antisense oligonucleotide
cgctatctgagcagcg

SEQ ID NO: 98 - DNA, 15 bp, Artificial Sequence
  Description of Artificial Sequence: antisense oligonucleotide
ccagtgtgatgatgg

SEQ ID NO: 99 - DNA, 18 bp, Artificial Sequence
  Description of Artificial Sequence: antisense oligonucleotide
ccagtagattaccactgg

SEQ ID NO: 100 - DNA, 16 bp, Artificial Sequence
  Description of Artificial Sequence: antisense oligonucleotide
ggcacaaacacgcacc

SEQ ID NO: 101 - DNA, 15 bp, Artificial Sequence
  Description of Artificial Sequence: antisense oligonucleotide
ccacggatctgaagg

SEQ ID NO: 102 - DNA, 17 bp, Artificial Sequence
  Description of Artificial Sequence: antisense oligonucleotide
cggaacatctcgaagcg

SEQ ID NO: 103 - DNA, 17 bp, Artificial Sequence
  Description of Artificial Sequence: antisense oligonucleotide
cctcattcagctctcgg

SEQ ID NO: 104 - DNA, 15 bp, Artificial Sequence
  Description of Artificial Sequence: antisense oligonucleotide
ccttgagttccaagg

SEQ ID NO: 105 - DNA, 17 bp, Artificial Sequence
  Description of Artificial Sequence: antisense oligonucleotide
cctttttggacttcagg

SEQ ID NO: 106 - DNA, 16 bp, Artificial Sequence
  Description of Artificial Sequence: antisense oligonucleotide
ggaggtagactgaccc

SEQ ID NO: 107 - DNA, 12 bp, Artificial Sequence
  Description of Artificial Sequence: antisense oligonucleotide
aaaatgtttcct

SEQ ID NO: 108 - DNA, 12 bp, Artificial Sequence
  Description of Artificial Sequence: antisense oligonucleotide
tgaaaatgtttc

SEQ ID NO: 109 - DNA, 12 bp, Artificial Sequence
  Description of Artificial Sequence: antisense oligonucleotide
ctgaaaatgttt

SEQ ID NO: 110 - DNA, 13 bp, Artificial Sequence
  Description of Artificial Sequence: antisense oligonucleotide
tctgaaaatgttt

SEQ ID NO: 111 - DNA, 12 bp, Artificial Sequence
  Description of Artificial Sequence: antisense oligonucleotide
tctgaaaatgtt

SEQ ID NO: 112 - DNA, 12 bp, Artificial Sequence
  Description of Artificial Sequence: antisense oligonucleotide
aaatcatccatt

SEQ ID NO: 113 - DNA, 12 bp, Artificial Sequence
  Description of Artificial Sequence: antisense oligonucleotide
ttgttcaatatc

SEQ ID NO: 114 - DNA, 13 bp, Artificial Sequence
  Description of Artificial Sequence: antisense oligonucleotide
attgttcaatatc

SEQ ID NO: 115 - DNA, 12 bp, Artificial Sequence
  Description of Artificial Sequence: antisense oligonucleotide
attgttcaatat

SEQ ID NO: 116 - DNA, 13 bp, Artificial Sequence
  Description of Artificial Sequence: antisense oligonucleotide
cattgttcaatat

SEQ ID NO: 117 - DNA, 12 bp, Artificial Sequence
  Description of Artificial Sequence: antisense oligonucleotide
cattgttcaata

SEQ ID NO: 118 - DNA, 12 bp, Artificial Sequence
  Description of Artificial Sequence: antisense oligonucleotide
aaaagtgtttct

SEQ ID NO: 119 - DNA, 15 bp, Artificial Sequence
  Description of Artificial Sequence: antisense oligonucleotide
acatgagttttttat

SEQ ID NO: 120 - DNA, 16 bp, Artificial Sequence
  Description of Artificial Sequence: antisense oligonucleotide
aacatgagttttttat

SEQ ID NO: 121 - DNA, 14 bp, Artificial Sequence
  Description of Artificial Sequence: antisense oligonucleotide
acatgagtttttta

SEQ ID NO: 122 - DNA, 15 bp, Artificial Sequence
  Description of Artificial Sequence: antisense oligonucleotide
aacatgagtttttta

SEQ ID NO: 123 - DNA, 14 bp, Artificial Sequence
  Description of Artificial Sequence: antisense oligonucleotide
aacatgagtttttt

SEQ ID NO: 124 - DNA, 13 bp, Artificial Sequence
  Description of Artificial Sequence: antisense oligonucleotide
aaaacatcttgtt

SEQ ID NO: 125 - DNA, 18 bp, Artificial Sequence
  Description of Artificial Sequence: antisense oligonucleotide
cagaggggggctcgacgc

SEQ ID NO: 126 - DNA, 18 bp, Artificial Sequence
  Description of Artificial Sequence: antisense oligonucleotide
ctgactcagagggggctc

SEQ ID NO: 127 - DNA, 14 bp, Artificial Sequence
  Description of Artificial Sequence: antisense oligonucleotide
agggggacagaacg

SEQ ID NO: 128 - DNA, 23 bp, Artificial Sequence
  Description of Artificial Sequence: antisense oligonucleotide
ttgggacggcaagggggacagaa

SEQ ID NO: 129 - DNA, 17 bp, Artificial Sequence
  Description of Artificial Sequence: antisense oligonucleotide
tgggacggcaaggggga

SEQ ID NO: 130 - DNA, 15 bp, Artificial Sequence
  Description of Artificial Sequence: antisense oligonucleotide
gccacggggggagca

SEQ ID NO: 131 - DNA, 19 bp, Artificial Sequence
  Description of Artificial Sequence: antisense oligonucleotide
gcaggggccacggggggag

SEQ ID NO: 132 - DNA, 14 bp, Artificial Sequence
  Description of Artificial Sequence: antisense oligonucleotide
aggggccacggggg

SEQ ID NO: 133 - DNA, 14 bp, Artificial Sequence
  Description of Artificial Sequence: antisense oligonucleotide
caggggccacgggg

SEQ ID NO: 134 - DNA, 15 bp, Artificial Sequence
  Description of Artificial Sequence: antisense oligonucleotide
ggtgcaggggccacg

SEQ ID NO: 135 - DNA, 18 bp, Artificial Sequence
  Description of Artificial Sequence: antisense oligonucleotide
tggtgcaggggccgccgg

SEQ ID NO: 136 - DNA, 18 bp, Artificial Sequence
  Description of Artificial Sequence: antisense oligonucleotide
ggggctggtgcaggggcc

SEQ ID NO: 137 - DNA, 18 bp, Artificial Sequence
  Description of Artificial Sequence: antisense oligonucleotide
agggggctggtgcagggg

SEQ ID NO: 138 - DNA, 14 bp, Artificial Sequence
  Description of Artificial Sequence: antisense oligonucleotide
gggctggtgcaggg

SEQ ID NO: 139 - DNA, 16 bp, Artificial Sequence
  Description of Artificial Sequence: antisense oligonucleotide
gagggggctggtgcag

SEQ ID NO: 140 - DNA, 15 bp, Artificial Sequence
  Description of Artificial Sequence: antisense oligonucleotide
aggagggggctggtg

SEQ ID NO: 141 - DNA, 18 bp, Artificial Sequence
  Description of Artificial Sequence: antisense oligonucleotide
gggccaggagggggctgg

SEQ ID NO: 142 - DNA, 18 bp, Artificial Sequence
  Description of Artificial Sequence: antisense oligonucleotide
aggggccaggagggggct

SEQ ID NO: 143 - DNA, 14 bp, Artificial Sequence
  Description of Artificial Sequence: antisense oligonucleotide
ggggccaggagggg

SEQ ID NO: 144 - DNA, 15 bp, Artificial Sequence
  Description of Artificial Sequence: antisense oligonucleotide
caggggccaggaggg

SEQ ID NO: 145 - DNA, 16 bp, Artificial Sequence
  Description of Artificial Sequence: antisense oligonucleotide
tctgggaagggacaga

SEQ ID NO: 146 - DNA, 16 bp, Artificial Sequence
  Description of Artificial Sequence: antisense oligonucleotide
tgagggcaggggagta

SEQ ID NO: 147 - DNA, 15 bp, Artificial Sequence
  Description of Artificial Sequence: antisense oligonucleotide
ttgagggcaggggag

SEQ ID NO: 148 - DNA, 19 bp, Artificial Sequence
  Description of Artificial Sequence: antisense oligonucleotide
cgggtgccgggcgggggtg

SEQ ID NO: 149 - DNA, 24 bp, Artificial Sequence
  Description of Artificial Sequence: antisense oligonucleotide
cggacgcgggtgccgggcgggggt

SEQ ID NO: 150 - DNA, 15 bp, Artificial Sequence
  Description of Artificial Sequence: antisense oligonucleotide
cgggtgccgggcggg

SEQ ID NO: 151 - DNA, 18 bp, Artificial Sequence
  Description of Artificial Sequence: antisense oligonucleotide
ggacgcgggtgccgggcg

SEQ ID NO: 152 - DNA, 18 bp, Artificial Sequence
  Description of Artificial Sequence: antisense oligonucleotide
tgggggcagcgcctcaca

SEQ ID NO: 153 - DNA, 16 bp, Artificial Sequence
  Description of Artificial Sequence: antisense oligonucleotide
ggtgggggcagcgcct

SEQ ID NO: 154 - DNA, 20 bp, Artificial Sequence
  Description of Artificial Sequence: antisense oligonucleotide
ccattttagtgcacatccgg

SEQ ID NO: 155 - DNA, 18 bp, Artificial Sequence
  Description of Artificial Sequence: antisense oligonucleotide
ccattttagtgcacatcc

SEQ ID NO: 156 - DNA, 18 bp, Artificial Sequence
  Description of Artificial Sequence: antisense oligonucleotide
gctgttccattttagtgc

SEQ ID NO: 157 - DNA, 14 bp, Artificial Sequence
  Description of Artificial Sequence: antisense oligonucleotide
gtagtcgtgtagag

SEQ ID NO: 158 - DNA, 16 bp, Artificial Sequence
  Description of Artificial Sequence: antisense oligonucleotide
gtttgtagtcgtgtag

SEQ ID NO: 159 - DNA, 17 bp, Artificial Sequence
  Description of Artificial Sequence: antisense oligonucleotide
gtttcaggagtttgtag

SEQ ID NO: 160 - DNA, 15 bp, Artificial Sequence
  Description of Artificial Sequence: antisense oligonucleotide
ccagctccgaagagg

SEQ ID NO: 161 - DNA, 16 bp, Artificial Sequence
  Description of Artificial Sequence: antisense oligonucleotide
cgtcgtcgtgatcacg

SEQ ID NO: 162 - DNA, 16 bp, Artificial Sequence
  Description of Artificial Sequence: antisense oligonucleotide
ggtaaaagtactgtcc

SEQ ID NO: 163 - DNA, 15 bp, Artificial Sequence
  Description of Artificial Sequence: antisense oligonucleotide
ggctttgacaaagcc

SEQ ID NO: 164 - DNA, 18 bp, Artificial Sequence
  Description of Artificial Sequence: antisense oligonucleotide
cttgtgcagatcgtccag

SEQ ID NO: 165 - DNA, 17 bp, Artificial Sequence
  Description of Artificial Sequence: antisense oligonucleotide
cgtggttcatcttgtgc

SEQ ID NO: 166 - DNA, 18 bp, Artificial Sequence
  Description of Artificial Sequence: antisense oligonucleotide
cacgtggttcatcttgtg

SEQ ID NO: 167 - DNA, 15 bp, Artificial Sequence
  Description of Artificial Sequence: antisense oligonucleotide
cctccttgaaggtgg

SEQ ID NO: 168 - DNA, 17 bp, Artificial Sequence
  Description of Artificial Sequence: antisense oligonucleotide
cgctccactttgatgcg

SEQ ID NO: 169 - DNA, 14 bp, Artificial Sequence
  Description of Artificial Sequence: antisense oligonucleotide
ccttgtcctccagg

SEQ ID NO: 170 - DNA, 14 bp, Artificial Sequence
  Description of Artificial Sequence: antisense oligonucleotide
ggtactcgacagcc

SEQ ID NO: 171 - DNA, 15 bp, Artificial Sequence
  Description of Artificial Sequence: antisense oligonucleotide
ctgacgtgggtcatg

SEQ ID NO: 172 - DNA, 15 bp, Artificial Sequence
  Description of Artificial Sequence: antisense oligonucleotide
ccgttgctgacgtgg

SEQ ID NO: 173 - DNA, 14 bp, Artificial Sequence
  Description of Artificial Sequence: antisense oligonucleotide
catcctccgcctcc

SEQ ID NO: 174 - DNA, 14 bp, Artificial Sequence
  Description of Artificial Sequence: antisense oligonucleotide
gtttccatcctccg

SEQ ID NO: 175 - DNA, 16 bp, Artificial Sequence
  Description of Artificial Sequence: antisense oligonucleotide
ggtgtttccatcctcc

SEQ ID NO: 176 - DNA, 15 bp, Artificial Sequence
  Description of Artificial Sequence: antisense oligonucleotide
ggtgtttccatcctc

SEQ ID NO: 177 - DNA, 15 bp, Artificial Sequence
  Description of Artificial Sequence: antisense oligonucleotide
gctcagcgcctcatc

SEQ ID NO: 178 - DNA, 18 bp, Artificial Sequence
  Description of Artificial Sequence: antisense oligonucleotide
ccttcttcatcatgctgc

SEQ ID NO: 179 - DNA, 17 bp, Artificial Sequence
  Description of Artificial Sequence: antisense oligonucleotide
ccttcttcatcatgctg

SEQ ID NO: 180 - DNA, 15 bp, Artificial Sequence
  Description of Artificial Sequence: antisense oligonucleotide
ccttcttcatcatgc

SEQ ID NO: 181 - DNA, 19 bp, Artificial Sequence
  Description of Artificial Sequence: antisense oligonucleotide
gcgtccttcttcatcatgc

SEQ ID NO: 182 - DNA, 14 bp, Artificial Sequence
  Description of Artificial Sequence: antisense oligonucleotide
cctgctcactcagg

SEQ ID NO: 183 - DNA, 14 bp, Artificial Sequence
  Description of Artificial Sequence: antisense oligonucleotide
cgcaggcttgagcg

SEQ ID NO: 184 - DNA, 15 bp, Artificial Sequence
  Description of Artificial Sequence: antisense oligonucleotide
gccagcttcagcagc

SEQ ID NO: 185 - DNA, 14 bp, Artificial Sequence
  Description of Artificial Sequence: antisense oligonucleotide
ggtggtgaccagcc

SEQ ID NO: 186 - DNA, 14 bp, Artificial Sequence
  Description of Artificial Sequence: antisense oligonucleotide
cctcggcgaactcc

SEQ ID NO: 187 - DNA, 14 bp, Artificial Sequence
  Description of Artificial Sequence: antisense oligonucleotide
gcttgtgtaaatcc

SEQ ID NO: 188 - DNA, 20 bp, Artificial Sequence
  Description of Artificial Sequence: antisense oligonucleotide
ggttctgcttgtgtaaatcc

SEQ ID NO: 189 - DNA, 15 bp, Artificial Sequence
  Description of Artificial Sequence: antisense oligonucleotide
gctgctcaggttcgc

SEQ ID NO: 190 - DNA, 14 bp, Artificial Sequence
  Description of Artificial Sequence: antisense oligonucleotide
gaaggcgaccgtcg

SEQ ID NO: 191 - DNA, 14 bp, Artificial Sequence
  Description of Artificial Sequence: antisense oligonucleotide
cgaaggcgaccgtc

SEQ ID NO: 192 - DNA, 14 bp, Artificial Sequence
  Description of Artificial Sequence: antisense oligonucleotide
gcaccgtctgtggc

SEQ ID NO: 193 - DNA, 17 bp, Artificial Sequence
  Description of Artificial Sequence: antisense oligonucleotide
cgtgtccatgtcgatgg

SEQ ID NO: 194 - DNA, 16 bp, Artificial Sequence
  Description of Artificial Sequence: antisense oligonucleotide
cgtgtccatgtcgatg

SEQ ID NO: 195 - DNA, 14 bp, Artificial Sequence
  Description of Artificial Sequence: antisense oligonucleotide
gcgtgtccatgtcg

SEQ ID NO: 196 - DNA, 15 bp, Artificial Sequence
  Description of Artificial Sequence: antisense oligonucleotide
ccagcttgcgcttgc

SEQ ID NO: 197 - DNA, 14 bp, Artificial Sequence
  Description of Artificial Sequence: antisense oligonucleotide
cgctccagcttgcg

SEQ ID NO: 198 - DNA, 18 bp, Artificial Sequence
  Description of Artificial Sequence: antisense oligonucleotide
cgtgttctgactcttgag

SEQ ID NO: 199 - DNA, 16 bp, Artificial Sequence
  Description of Artificial Sequence: antisense oligonucleotide
cgtgttctgactcttg

SEQ ID NO: 200 - DNA, 14 bp, Artificial Sequence
  Description of Artificial Sequence: antisense oligonucleotide
gctgttgacgtggc

SEQ ID NO: 201 - DNA, 14 bp, Artificial Sequence
  Description of Artificial Sequence: antisense oligonucleotide
cgactcagtacgcc

SEQ ID NO: 202 - DNA, 14 bp, Artificial Sequence
  Description of Artificial Sequence: antisense oligonucleotide
gccatgcccgactc

SEQ ID NO: 203 - DNA, 14 bp, Artificial Sequence
  Description of Artificial Sequence: antisense oligonucleotide
cccttggaggtggc

SEQ ID NO: 204 - DNA, 13 bp, Artificial Sequence
  Description of Artificial Sequence: antisense oligonucleotide
ttttagtgcacat

SEQ ID NO: 205 - DNA, 14 bp, Artificial Sequence
  Description of Artificial Sequence: antisense oligonucleotide
tgttccattttagt

SEQ ID NO: 206 - DNA, 14 bp, Artificial Sequence
  Description of Artificial Sequence: antisense oligonucleotide
aaaaaaagtggaag

SEQ ID NO: 207 - DNA, 14 bp, Artificial Sequence
  Description of Artificial Sequence: antisense oligonucleotide
tacaaaaaaaagtg

SEQ ID NO: 208 - DNA, 14 bp, Artificial Sequence
  Description of Artificial Sequence: antisense oligonucleotide
atacaaaaaaaagt

SEQ ID NO: 209 - DNA, 15 bp, Artificial Sequence
  Description of Artificial Sequence: antisense oligonucleotide
catacaaaaaaaagt

SEQ ID NO: 210 - DNA, 14 bp, Artificial Sequence
  Description of Artificial Sequence: antisense oligonucleotide
catacaaaaaaaag

SEQ ID NO: 211 - DNA, 14 bp, Artificial Sequence
  Description of Artificial Sequence: antisense oligonucleotide
gaaaaaaaacatac

SEQ ID NO: 212 - DNA, 16 bp, Artificial Sequence
  Description of Artificial Sequence: antisense oligonucleotide
cagaaaaaaaacatac

SEQ ID NO: 213 - DNA, 14 bp, Artificial Sequence
  Description of Artificial Sequence: antisense oligonucleotide
cagaaaaaaaacat

SEQ ID NO: 214 - DNA, 14 bp, Artificial Sequence
  Description of Artificial Sequence: antisense oligonucleotide
ttcaatatgaatcg

SEQ ID NO: 215 - DNA, 16 bp, Artificial Sequence
  Description of Artificial Sequence: antisense oligonucleotide
tattcaatatgaatcg

SEQ ID NO: 216 - DNA, 15 bp, Artificial Sequence
  Description of Artificial Sequence: antisense oligonucleotide
tattcaatatgaatc

SEQ ID NO: 217 - DNA, 14 bp, Artificial Sequence
  Description of Artificial Sequence: antisense oligonucleotide
tattcaatatgaat

SEQ ID NO: 218 - DNA, 15 bp, Artificial Sequence
  Description of Artificial Sequence: antisense oligonucleotide
tatattcaatatgaa

SEQ ID NO: 219 - DNA, 15 bp, Artificial Sequence
  Description of Artificial Sequence: antisense oligonucleotide
ttatattcaatatga

SEQ ID NO: 220 - DNA, 17 bp, Artificial Sequence
  Description of Artificial Sequence: antisense oligonucleotide
tattatattcaatatga

SEQ ID NO: 221 - DNA, 14 bp, Artificial Sequence
  Description of Artificial Sequence: antisense oligonucleotide
ttatattcaatatg

SEQ ID NO: 222 - DNA, 16 bp, Artificial Sequence
  Description of Artificial Sequence: antisense oligonucleotide
tattatattcaatatg

SEQ ID NO: 223 - DNA, 14 bp, Artificial Sequence
  Description of Artificial Sequence: antisense oligonucleotide
attatattcaatat

SEQ ID NO: 224 - DNA, 15 bp, Artificial Sequence
  Description of Artificial Sequence: antisense oligonucleotide
tattatattcaatat

SEQ ID NO: 225 - DNA, 18 bp, Artificial Sequence
  Description of Artificial Sequence: antisense oligonucleotide
atatattatattcaatat

SEQ ID NO: 226 - DNA, 20 bp, Artificial Sequence
  Description of Artificial Sequence: antisense oligonucleotide
aaatatattatattcaatat

SEQ ID NO: 227 - DNA, 14 bp, Artificial Sequence
  Description of Artificial Sequence: antisense oligonucleotide
tattatattcaata

SEQ ID NO: 228 - DNA, 17 bp, Artificial Sequence
  Description of Artificial Sequence: antisense oligonucleotide
atatattatattcaata

SEQ ID NO: 229 - DNA, 20 bp, Artificial Sequence
  Description of Artificial Sequence: antisense oligonucleotide
caaatatattatattcaata

SEQ ID NO: 230 - DNA, 15 bp, Artificial Sequence
  Description of Artificial Sequence: antisense oligonucleotide
tatattatattcaat

SEQ ID NO: 231 - DNA, 17 bp, Artificial Sequence
  Description of Artificial Sequence: antisense oligonucleotide
aatatattatattcaat

SEQ ID NO: 232 - DNA, 14 bp, Artificial Sequence
  Description of Artificial Sequence: antisense oligonucleotide
tatattatattcaa

SEQ ID NO: 233 - DNA, 18 bp, Artificial Sequence
  Description of Artificial Sequence: antisense oligonucleotide
caaatatattatattcaa

SEQ ID NO: 234 - DNA, 17 bp, Artificial Sequence
  Description of Artificial Sequence: antisense oligonucleotide
caaatatattatattca

SEQ ID NO: 235 - DNA, 16 bp, Artificial Sequence
  Description of Artificial Sequence: antisense oligonucleotide
caaatatattatattc

SEQ ID NO: 236 - DNA, 18 bp, Artificial Sequence
  Description of Artificial Sequence: antisense oligonucleotide
cacaaatatattatattc

SEQ ID NO: 237 - DNA, 14 bp, Artificial Sequence
  Description of Artificial Sequence: antisense oligonucleotide
aaatatattatatt

SEQ ID NO: 238 - DNA, 15 bp, Artificial Sequence
  Description of Artificial Sequence: antisense oligonucleotide
caaatatattatatt

SEQ ID NO: 239 - DNA, 14 bp, Artificial Sequence
  Description of Artificial Sequence: antisense oligonucleotide
caaatatattatat

SEQ ID NO: 240 - DNA, 16 bp, Artificial Sequence
  Description of Artificial Sequence: antisense oligonucleotide
cacaaatatattatat

SEQ ID NO: 241 - DNA, 14 bp, Artificial Sequence
  Description of Artificial Sequence: antisense oligonucleotide
cacaaatatattat

SEQ ID NO: 242 - DNA, 16 bp, Artificial Sequence
  Description of Artificial Sequence: antisense oligonucleotide
tacacaaatatattat

SEQ ID NO: 243 - DNA, 15 bp, Artificial Sequence
  Description of Artificial Sequence: antisense oligonucleotide
tacacaaatatatta

SEQ ID NO: 244 - DNA, 18 bp, Artificial Sequence
  Description of Artificial Sequence: antisense oligonucleotide
taaatacacaaatatatt

SEQ ID NO: 245 - DNA, 14 bp, Artificial Sequence
  Description of Artificial Sequence: antisense oligonucleotide
aatacacaaatata

SEQ ID NO: 246 - DNA, 16 bp, Artificial Sequence
  Description of Artificial Sequence: antisense oligonucleotide
gttaaatacacaaata

SEQ ID NO: 247 - DNA, 14 bp, Artificial Sequence
  Description of Artificial Sequence: antisense oligonucleotide
tgttaaatacacaa

SEQ ID NO: 248 - DNA, 14 bp, Artificial Sequence
  Description of Artificial Sequence: antisense oligonucleotide
tttagagactaagt

SEQ ID NO: 249 - DNA, 14 bp, Artificial Sequence
  Description of Artificial Sequence: antisense oligonucleotide
ataaactctttaga

SEQ ID NO: 250 - DNA, 17 bp, Artificial Sequence
  Description of Artificial Sequence: antisense oligonucleotide
taaaataaactctttag

SEQ ID NO: 251 - DNA, 16 bp, Artificial Sequence
  Description of Artificial Sequence: antisense oligonucleotide
taaaataaactcttta

SEQ ID NO: 252 - DNA, 16 bp, Artificial Sequence
  Description of Artificial Sequence: antisense oligonucleotide
ttaaaataaactcttt

SEQ ID NO: 253 - DNA, 14 bp, Artificial Sequence
  Description of Artificial Sequence: antisense oligonucleotide
cttaaaataaactc

SEQ ID NO: 254 - DNA, 15 bp, Artificial Sequence
  Description of Artificial Sequence: antisense oligonucleotide
taaaaagaacaaaca

SEQ ID NO: 255 - DNA, 14 bp, Artificial Sequence
  Description of Artificial Sequence: antisense oligonucleotide
taaaaagaacaaac

SEQ ID NO: 256 - DNA, 15 bp, Artificial Sequence
  Description of Artificial Sequence: antisense oligonucleotide
caataaaaagaacaa

SEQ ID NO: 257 - DNA, 16 bp, Artificial Sequence
  Description of Artificial Sequence: antisense oligonucleotide
tcaataaaaagaacaa

SEQ ID NO: 258 - DNA, 14 bp, Artificial Sequence
  Description of Artificial Sequence: antisense oligonucleotide
tcaataaaaagaac

SEQ ID NO: 259 - DNA, 14 bp, Artificial Sequence
  Description of Artificial Sequence: antisense oligonucleotide
ttcaataaaaagaa

SEQ ID NO: 260 - DNA, 17 bp, Artificial Sequence
  Description of Artificial Sequence: antisense oligonucleotide
tagattcaataaaaaga

SEQ ID NO: 261 - DNA, 17 bp, Artificial Sequence
  Description of Artificial Sequence: antisense oligonucleotide
tggcgcgggcgggtagc

SEQ ID NO: 262 - DNA, 20 bp, Artificial Sequence
  Description of Artificial Sequence: antisense oligonucleotide
gggctggcgcgggcgggtag

SEQ ID NO: 263 - DNA, 21 bp, Artificial Sequence
  Description of Artificial Sequence: antisense oligonucleotide
tcgggggctggcgcgggcggg

SEQ ID NO: 264 - DNA, 26 bp, Artificial Sequence
  Description of Artificial Sequence: antisense oligonucleotide
tgggtgcctggtcgcgcgttctcggg

SEQ ID NO: 265 - DNA, 18 bp, Artificial Sequence
  Description of Artificial Sequence: antisense oligonucleotide
agggtccctgcggggccg

SEQ ID NO: 266 - DNA, 18 bp, Artificial Sequence
  Description of Artificial Sequence: antisense oligonucleotide
gggagggtccctgcgggg

SEQ ID NO: 267 - DNA, 16 bp, Artificial Sequence
  Description of Artificial Sequence: antisense oligonucleotide
gggagggtccctgcgg

SEQ ID NO: 268 - DNA, 14 bp, Artificial Sequence
  Description of Artificial Sequence: antisense oligonucleotide
tgggccgggtccgc

SEQ ID NO: 269 - DNA, 14 bp, Artificial Sequence
  Description of Artificial Sequence: antisense oligonucleotide
tcccgggggtgtag

SEQ ID NO: 270 - DNA, 19 bp, Artificial Sequence
  Description of Artificial Sequence: antisense oligonucleotide
agtactgtcccgggggtgt

SEQ ID NO: 271 - DNA, 18 bp, Artificial Sequence
  Description of Artificial Sequence: antisense oligonucleotide
gggacacgttggggggtg

SEQ ID NO: 272 - DNA, 20 bp, Artificial Sequence
  Description of Artificial Sequence: antisense oligonucleotide
gccgggggccccccggtagc

SEQ ID NO: 273 - DNA, 17 bp, Artificial Sequence
  Description of Artificial Sequence: antisense oligonucleotide
cgggcccagccgggggc

SEQ ID NO: 274 - DNA, 14 bp, Artificial Sequence
  Description of Artificial Sequence: antisense oligonucleotide
cgggcccagccggg

SEQ ID NO: 275 - DNA, 20 bp, Artificial Sequence
  Description of Artificial Sequence: antisense oligonucleotide
gggaggtggctccgggccgg

SEQ ID NO: 276 - DNA, 18 bp, Artificial Sequence
  Description of Artificial Sequence: antisense oligonucleotide
agggcggcgcgtgtggga

SEQ ID NO: 277 - DNA, 20 bp, Artificial Sequence
  Description of Artificial Sequence: antisense oligonucleotide
gggtggccaccggcgaaggg

SEQ ID NO: 278 - DNA, 15 bp, Artificial Sequence
  Description of Artificial Sequence: antisense oligonucleotide
aggggcaggggacgt

SEQ ID NO: 279 - DNA, 18 bp, Artificial Sequence
  Description of Artificial Sequence: antisense oligonucleotide
taaaggggcaggggacgt

SEQ ID NO: 280 - DNA, 20 bp, Artificial Sequence
  Description of Artificial Sequence: antisense oligonucleotide
agggggtgtccgtaaagggg

SEQ ID NO: 281 - DNA, 21 bp, Artificial Sequence
  Description of Artificial Sequence: antisense oligonucleotide
ggggacgcgaacgtgccgccg

SEQ ID NO: 282 - DNA, 21 bp, Artificial Sequence
  Description of Artificial Sequence: antisense oligonucleotide
cggggaacaagcggcccgggg

SEQ ID NO: 283 - DNA, 14 bp, Artificial Sequence
  Description of Artificial Sequence: antisense oligonucleotide
ggccgtcgggggcg

SEQ ID NO: 284 - DNA, 15 bp, Artificial Sequence
  Description of Artificial Sequence: antisense oligonucleotide
gcggccgtcgggggc

SEQ ID NO: 285 - DNA, 18 bp, Artificial Sequence
  Description of Artificial Sequence: antisense oligonucleotide
aggggggtaggaggcggg

SEQ ID NO: 286 - DNA, 14 bp, Artificial Sequence
  Description of Artificial Sequence: antisense oligonucleotide
gcgctgggggcgcc

SEQ ID NO: 287 - DNA, 14 bp, Artificial Sequence
  Description of Artificial Sequence: antisense oligonucleotide
ggccgtcggggggt

SEQ ID NO: 288 - DNA, 15 bp, Artificial Sequence
  Description of Artificial Sequence: antisense oligonucleotide
ggggaggccagcttc

SEQ ID NO: 289 - DNA, 16 bp, Artificial Sequence
  Description of Artificial Sequence: antisense oligonucleotide
ggccgccaccttgggg

SEQ ID NO: 290 - DNA, 16 bp, Artificial Sequence
  Description of Artificial Sequence: antisense oligonucleotide
gcggccgccgccgggg

SEQ ID NO: 291 - DNA, 20 bp, Artificial Sequence
  Description of Artificial Sequence: antisense oligonucleotide
gggcgcggccgccgccgggg

SEQ ID NO: 292 - DNA, 16 bp, Artificial Sequence
  Description of Artificial Sequence: antisense oligonucleotide
ggggtggcggcggcgg

SEQ ID NO: 293 - DNA, 15 bp, Artificial Sequence
  Description of Artificial Sequence: antisense oligonucleotide
gggggtggcggcggc

SEQ ID NO: 294 - DNA, 18 bp, Artificial Sequence
  Description of Artificial Sequence: antisense oligonucleotide
tggggcagcagctggcag

SEQ ID NO: 295 - DNA, 18 bp, Artificial Sequence
  Description of Artificial Sequence: antisense oligonucleotide
cggggcgcccacgacacc

SEQ ID NO: 296 - DNA, 17 bp, Artificial Sequence
  Description of Artificial Sequence: antisense oligonucleotide
cggggcgcccacgacac

SEQ ID NO: 297 - DNA, 26 bp, Artificial Sequence
  Description of Artificial Sequence: antisense oligonucleotide
gggccgcaccctctccaagtccgggg

SEQ ID NO: 298 - DNA, 14 bp, Artificial Sequence
  Description of Artificial Sequence: antisense oligonucleotide
gcagcagtcagtgg

SEQ ID NO: 299 - DNA, 16 bp, Artificial Sequence
  Description of Artificial Sequence: antisense oligonucleotide
ccattgtctagcacgg

SEQ ID NO: 300 - DNA, 17 bp, Artificial Sequence
  Description of Artificial Sequence: antisense oligonucleotide
ggtctccattgtctagc

SEQ ID NO: 301 - DNA, 16 bp, Artificial Sequence
  Description of Artificial Sequence: antisense oligonucleotide
ggtggtattgttcagc

SEQ ID NO: 302 - DNA, 15 bp, Artificial Sequence
  Description of Artificial Sequence: antisense oligonucleotide
gctggatcaagaccc

SEQ ID NO: 303 - DNA, 16 bp, Artificial Sequence
  Description of Artificial Sequence: antisense oligonucleotide
ccacaaaatcgtgtcc

SEQ ID NO: 304 - DNA, 20 bp, Artificial Sequence
  Description of Artificial Sequence: antisense oligonucleotide
ccttccacaaaatcgtgtcc

SEQ ID NO: 305 - DNA, 14 bp, Artificial Sequence
  Description of Artificial Sequence: antisense oligonucleotide
ggttgttcttgtgg

SEQ ID NO: 306 - DNA, 14 bp, Artificial Sequence
  Description of Artificial Sequence: antisense oligonucleotide
cctcttggttgtgc

SEQ ID NO: 307 - DNA, 20 bp, Artificial Sequence
  Description of Artificial Sequence: antisense oligonucleotide
ccagagtctcaaacacttgg

SEQ ID NO: 308 - DNA, 20 bp, Artificial Sequence
  Description of Artificial Sequence: antisense oligonucleotide
ggtaacctgtgatctcttcc

SEQ ID NO: 309 - DNA, 14 bp, Artificial Sequence
  Description of Artificial Sequence: antisense oligonucleotide
cctgcagtactcgg

SEQ ID NO: 310 - DNA, 16 bp, Artificial Sequence
  Description of Artificial Sequence: antisense oligonucleotide
ggcattcacatactcc

SEQ ID NO: 311 - DNA, 16 bp, Artificial Sequence
  Description of Artificial Sequence: antisense oligonucleotide
ggcattcacatactcc

SEQ ID NO: 312 - DNA, 17 bp, Artificial Sequence
  Description of Artificial Sequence: antisense oligonucleotide
cgcatcgtgtacttccg

SEQ ID NO: 313 - DNA, 14 bp, Artificial Sequence
  Description of Artificial Sequence: antisense oligonucleotide
gcacgttccgagcg

SEQ ID NO: 314 - DNA, 15 bp, Artificial Sequence
  Description of Artificial Sequence: antisense oligonucleotide
ggtaccagatactcc

SEQ ID NO: 315 - DNA, 15 bp, Artificial Sequence
  Description of Artificial Sequence: antisense oligonucleotide
ccagtggagacctgg

SEQ ID NO: 316 - DNA, 17 bp, Artificial Sequence
  Description of Artificial Sequence: antisense oligonucleotide
cctgaggacacatcagg

SEQ ID NO: 317 - DNA, 18 bp, Artificial Sequence
  Description of Artificial Sequence: antisense oligonucleotide
cctcacttggttgtgagc

SEQ ID NO: 318 - DNA, 15 bp, Artificial Sequence
  Description of Artificial Sequence: antisense oligonucleotide
ggaagatgtccttcc

SEQ ID NO: 319 - DNA, 16 bp, Artificial Sequence
  Description of Artificial Sequence: antisense oligonucleotide
gcacactgctcatggc

SEQ ID NO: 320 - DNA, 15 bp, Artificial Sequence
  Description of Artificial Sequence: antisense oligonucleotide
gctgtcacctcttgg

SEQ ID NO: 321 - DNA, 14 bp, Artificial Sequence
  Description of Artificial Sequence: antisense oligonucleotide
cctctgctgtcacc

SEQ ID NO: 322 - DNA, 16 bp, Artificial Sequence
  Description of Artificial Sequence: antisense oligonucleotide
ccacacatcactctgg

SEQ ID NO: 323 - DNA, 15 bp, Artificial Sequence
  Description of Artificial Sequence: antisense oligonucleotide
cctcctcttcagagg

SEQ ID NO: 324 - DNA, 18 bp, Artificial Sequence
  Description of Artificial Sequence: antisense oligonucleotide
ccttctggttcacactgg

SEQ ID NO: 325 - DNA, 16 bp, Artificial Sequence
  Description of Artificial Sequence: antisense oligonucleotide
catggtgctcactgcg

SEQ ID NO: 326 - DNA, 14 bp, Artificial Sequence
  Description of Artificial Sequence: antisense oligonucleotide
cttggttgtgagcg

SEQ ID NO: 327 - DNA, 14 bp, Artificial Sequence
  Description of Artificial Sequence: antisense oligonucleotide
ggacaggcagtcac

SEQ ID NO: 328 - DNA, 18 bp, Artificial Sequence
  Description of Artificial Sequence: antisense oligonucleotide
gtcacctcttggttgtgc

SEQ ID NO: 329 - DNA, 16 bp, Artificial Sequence
  Description of Artificial Sequence: antisense oligonucleotide
ccagagtctcaaacac

SEQ ID NO: 330 - DNA, 14 bp, Artificial Sequence
  Description of Artificial Sequence: antisense oligonucleotide
cacatactccctgg

SEQ ID NO: 331 - DNA, 15 bp, Artificial Sequence
  Description of Artificial Sequence: antisense oligonucleotide
gaccagcacgttccg

SEQ ID NO: 332 - DNA, 17 bp, Artificial Sequence
  Description of Artificial Sequence: antisense oligonucleotide
gttggtgtctatcagtg

SEQ ID NO: 333 - DNA, 14 bp, Artificial Sequence
  Description of Artificial Sequence: antisense oligonucleotide
ccctggtagaggtg

SEQ ID NO: 334 - DNA, 16 bp, Artificial Sequence
  Description of Artificial Sequence: antisense oligonucleotide
ctcaaacacttggagc

SEQ ID NO: 335 - DNA, 18 bp, Artificial Sequence
  Description of Artificial Sequence: antisense oligonucleotide
cacacatcactctggtgg

SEQ ID NO: 336 - DNA, 15 bp, Artificial Sequence
  Description of Artificial Sequence: antisense oligonucleotide
gcacagacagtgcgc

SEQ ID NO: 337 - DNA, 15 bp, Artificial Sequence
  Description of Artificial Sequence: antisense oligonucleotide
catggcagcagtcag

SEQ ID NO: 338 - DNA, 16 bp, Artificial Sequence
  Description of Artificial Sequence: antisense oligonucleotide
ctgctcatggcagcag

SEQ ID NO: 339 - DNA, 20 bp, Artificial Sequence
  Description of Artificial Sequence: antisense oligonucleotide
catctggaaacttccagatg

SEQ ID NO: 340 - DNA, 14 bp, Artificial Sequence
  Description of Artificial Sequence: antisense oligonucleotide
ctggaaacttccag

SEQ ID NO: 341 - DNA, 20 bp, Artificial Sequence
  Description of Artificial Sequence: antisense oligonucleotide
cataactccacacatcactc

SEQ ID NO: 342 - DNA, 19 bp, Artificial Sequence
  Description of Artificial Sequence: antisense oligonucleotide
caccataactccacacatc

SEQ ID NO: 343 - DNA, 14 bp, Artificial Sequence
  Description of Artificial Sequence: antisense oligonucleotide
ctggtgggtgaacc

SEQ ID NO: 344 - DNA, 15 bp, Artificial Sequence
  Description of Artificial Sequence: antisense oligonucleotide
cggattacttgcagg

SEQ ID NO: 345 - DNA, 15 bp, Artificial Sequence
  Description of Artificial Sequence: antisense oligonucleotide
cgctaggtgtcagcg

SEQ ID NO: 346 - DNA, 14 bp, Artificial Sequence
  Description of Artificial Sequence: antisense oligonucleotide
gccatcacgtatgc

SEQ ID NO: 347 - DNA, 17 bp, Artificial Sequence
  Description of Artificial Sequence: antisense oligonucleotide
gcatacaccagttcagc

SEQ ID NO: 348 - DNA, 16 bp, Artificial Sequence
  Description of Artificial Sequence: antisense oligonucleotide
ccatcaaatacatcgg

SEQ ID NO: 349 - DNA, 15 bp, Artificial Sequence
  Description of Artificial Sequence: antisense oligonucleotide
ccagcagaagtcagg

SEQ ID NO: 350 - DNA, 15 bp, Artificial Sequence
  Description of Artificial Sequence: antisense oligonucleotide
gcttcatgtctgtgc

SEQ ID NO: 351 - DNA, 18 bp, Artificial Sequence
  Description of Artificial Sequence: antisense oligonucleotide
ggtgagttccaggtttcc

SEQ ID NO: 352 - DNA, 19 bp, Artificial Sequence
  Description of Artificial Sequence: antisense oligonucleotide
ccacaaaatcgtgtcctgg

SEQ ID NO: 353 - DNA, 14 bp, Artificial Sequence
  Description of Artificial Sequence: antisense oligonucleotide
cccttacacatcgg

SEQ ID NO: 354 - DNA, 15 bp, Artificial Sequence
  Description of Artificial Sequence: antisense oligonucleotide
gcagctcacagatgc

SEQ ID NO: 355 - DNA, 14 bp, Artificial Sequence
  Description of Artificial Sequence: antisense oligonucleotide
gcactggtaactgc

SEQ ID NO: 356 - DNA, 18 bp, Artificial Sequence
  Description of Artificial Sequence: antisense oligonucleotide
cctggatattggcactgg

SEQ ID NO: 357 - DNA, 15 bp, Artificial Sequence
  Description of Artificial Sequence: antisense oligonucleotide
ccagcaaactcctgg

SEQ ID NO: 358 - DNA, 15 bp, Artificial Sequence
  Description of Artificial Sequence: antisense oligonucleotide
gcagaaatgccaggc

SEQ ID NO: 359 - DNA, 17 bp, Artificial Sequence
  Description of Artificial Sequence: antisense oligonucleotide
ccattgtgcagaattcg

SEQ ID NO: 360 - DNA, 15 bp, Artificial Sequence
  Description of Artificial Sequence: antisense oligonucleotide
ccctgcagtactcgg

SEQ ID NO: 361 - DNA, 17 bp, Artificial Sequence
  Description of Artificial Sequence: antisense oligonucleotide
ggcattcacatactccc

SEQ ID NO: 362 - DNA, 16 bp, Artificial Sequence
  Description of Artificial Sequence: antisense oligonucleotide
ggtcaggtttcacacc

SEQ ID NO: 363 - DNA, 15 bp, Artificial Sequence
  Description of Artificial Sequence: antisense oligonucleotide
ccaggtccacacagg

SEQ ID NO: 364 - DNA, 14 bp, Artificial Sequence
  Description of Artificial Sequence: antisense oligonucleotide
ccttgtcatccagg

SEQ ID NO: 365 - DNA, 14 bp, Artificial Sequence
  Description of Artificial Sequence: antisense oligonucleotide
ggatcccaaagacc

SEQ ID NO: 366 - DNA, 17 bp, Artificial Sequence
  Description of Artificial Sequence: antisense oligonucleotide
cctcaacactttgatgg

SEQ ID NO: 367 - DNA, 14 bp, Artificial Sequence
  Description of Artificial Sequence: antisense oligonucleotide
gctgtgtcaccagc

SEQ ID NO: 368 - DNA, 16 bp, Artificial Sequence
  Description of Artificial Sequence: antisense oligonucleotide
ggtctaagaggcagcc

SEQ ID NO: 369 - DNA, 17 bp, Artificial Sequence
  Description of Artificial Sequence: antisense oligonucleotide
ggcaatctgcatacacc

SEQ ID NO: 370 - DNA, 14 bp, Artificial Sequence
  Description of Artificial Sequence: antisense oligonucleotide
cctgtgtacgagcc

SEQ ID NO: 371 - DNA, 15 bp, Artificial Sequence
  Description of Artificial Sequence: antisense oligonucleotide
ccatccacttgatgg

SEQ ID NO: 372 - DNA, 16 bp, Artificial Sequence
  Description of Artificial Sequence: antisense oligonucleotide
cccacacagtcacacc

SEQ ID NO: 373 - DNA, 16 bp, Artificial Sequence
  Description of Artificial Sequence: antisense oligonucleotide
ccatcgtaaggtttgg

SEQ ID NO: 374 - DNA, 14 bp, Artificial Sequence
  Description of Artificial Sequence: antisense oligonucleotide
ccttttccagcagg

SEQ ID NO: 375 - DNA, 16 bp, Artificial Sequence
  Description of Artificial Sequence: antisense oligonucleotide
ggagaattcagacacc

SEQ ID NO: 376 - DNA, 17 bp, Artificial Sequence
  Description of Artificial Sequence: antisense oligonucleotide
ccaagtcctcattctgg

SEQ ID NO: 377 - DNA, 16 bp, Artificial Sequence
  Description of Artificial Sequence: antisense oligonucleotide
ccatcagtctcagagg

SEQ ID NO: 378 - DNA, 16 bp, Artificial Sequence
  Description of Artificial Sequence: antisense oligonucleotide
cctttgaaggtgctgg

SEQ ID NO: 379 - DNA, 15 bp, Artificial Sequence
  Description of Artificial Sequence: antisense oligonucleotide
ggcatggcaggttcc

SEQ ID NO: 380 - DNA, 14 bp, Artificial Sequence
  Description of Artificial Sequence: antisense oligonucleotide
cctggcatggcagg

SEQ ID NO: 381 - DNA, 14 bp, Artificial Sequence
  Description of Artificial Sequence: antisense oligonucleotide
agatgtataggtaa

SEQ ID NO: 382 - DNA, 14 bp, Artificial Sequence
  Description of Artificial Sequence: antisense oligonucleotide
attttcacattctc

SEQ ID NO: 383 - DNA, 15 bp, Artificial Sequence
  Description of Artificial Sequence: antisense oligonucleotide
aattttcacattctc

SEQ ID NO: 384 - DNA, 14 bp, Artificial Sequence
  Description of Artificial Sequence: antisense oligonucleotide
aattttcacattct

SEQ ID NO: 385 - DNA, 14 bp, Artificial Sequence
  Description of Artificial Sequence: antisense oligonucleotide
gaattttcacattc

SEQ ID NO: 386 - DNA, 14 bp, Artificial Sequence
  Description of Artificial Sequence: antisense oligonucleotide
ggaattttcacatt

SEQ ID NO: 387 - DNA, 14 bp, Artificial Sequence
  Description of Artificial Sequence: antisense oligonucleotide
agatttctttgttg

SEQ ID NO: 388 - DNA, 15 bp, Artificial Sequence
  Description of Artificial Sequence: antisense oligonucleotide
aagatttctttgttg

SEQ ID NO: 389 - DNA, 14 bp, Artificial Sequence
  Description of Artificial Sequence: antisense oligonucleotide
aagatttctttgtt

SEQ ID NO: 390 - DNA, 15 bp, Artificial Sequence
  Description of Artificial Sequence: antisense oligonucleotide
taagatttctttgtt

SEQ ID NO: 391 - DNA, 16 bp, Artificial Sequence
  Description of Artificial Sequence: antisense oligonucleotide
ctaagatttctttgtt

SEQ ID NO: 392 - DNA, 14 bp, Artificial Sequence
  Description of Artificial Sequence: antisense oligonucleotide
taagatttctttgt

SEQ ID NO: 393 - DNA, 15 bp, Artificial Sequence
  Description of Artificial Sequence: antisense oligonucleotide
ctaagatttctttgt

SEQ ID NO: 394 - DNA, 14 bp, Artificial Sequence
  Description of Artificial Sequence: antisense oligonucleotide
ctaagatttctttg

SEQ ID NO: 395 - DNA, 14 bp, Artificial Sequence
  Description of Artificial Sequence: antisense oligonucleotide
tctaagatttcttt

SEQ ID NO: 396 - DNA, 15 bp, Artificial Sequence
  Description of Artificial Sequence: antisense oligonucleotide
gtctaagatttcttt

SEQ ID NO: 397 - DNA, 14 bp, Artificial Sequence
  Description of Artificial Sequence: antisense oligonucleotide
gtctaagatttctt

SEQ ID NO: 398 - DNA, 14 bp, Artificial Sequence
  Description of Artificial Sequence: antisense oligonucleotide
ttcgtctaagattt

SEQ ID NO: 399 - DNA, 14 bp, Artificial Sequence
  Description of Artificial Sequence: antisense oligonucleotide
attttgacatggtt

SEQ ID NO: 400 - DNA, 15 bp, Artificial Sequence
  Description of Artificial Sequence: antisense oligonucleotide
aattttgacatggtt

SEQ ID NO: 401 - DNA, 14 bp, Artificial Sequence
  Description of Artificial Sequence: antisense oligonucleotide
aattttgacatggt

SEQ ID NO: 402 - DNA, 15 bp, Artificial Sequence
  Description of Artificial Sequence: antisense oligonucleotide
taattttgacatggt

SEQ ID NO: 403 - DNA, 14 bp, Artificial Sequence
  Description of Artificial Sequence: antisense oligonucleotide
taattttgacatgg

SEQ ID NO: 404 - DNA, 14 bp, Artificial Sequence
  Description of Artificial Sequence: antisense oligonucleotide
gtaattttgacatg

SEQ ID NO: 405 - DNA, 15 bp, Artificial Sequence
  Description of Artificial Sequence: antisense oligonucleotide
tgtaattttgacatg

SEQ ID NO: 406 - DNA, 14 bp, Artificial Sequence
  Description of Artificial Sequence: antisense oligonucleotide
tgtaattttgacat

SEQ ID NO: 407 - DNA, 16 bp, Artificial Sequence
  Description of Artificial Sequence: antisense oligonucleotide
tctgtaattttgacat

SEQ ID NO: 408 - DNA, 14 bp, Artificial Sequence
  Description of Artificial Sequence: antisense oligonucleotide
ctgtaattttgaca

SEQ ID NO: 409 - DNA, 15 bp, Artificial Sequence
  Description of Artificial Sequence: antisense oligonucleotide
tctgtaattttgaca

SEQ ID NO: 410 - DNA, 14 bp, Artificial Sequence
  Description of Artificial Sequence: antisense oligonucleotide
tctgtaattttgac

SEQ ID NO: 411 - DNA, 14 bp, Artificial Sequence
  Description of Artificial Sequence: antisense oligonucleotide
gtctgtaattttga

SEQ ID NO: 412 - DNA, 16 bp, Artificial Sequence
  Description of Artificial Sequence: antisense oligonucleotide
aagtctgtaattttga

SEQ ID NO: 413 - DNA, 14 bp, Artificial Sequence
  Description of Artificial Sequence: antisense oligonucleotide
agtctgtaattttg

SEQ ID NO: 414 - DNA, 15 bp, Artificial Sequence
  Description of Artificial Sequence: antisense oligonucleotide
aagtctgtaattttg

SEQ ID NO: 415 - DNA, 14 bp, Artificial Sequence
  Description of Artificial Sequence: antisense oligonucleotide
aagtctgtaatttt

SEQ ID NO: 416 - DNA, 15 bp, Artificial Sequence
  Description of Artificial Sequence: antisense oligonucleotide
gaagtctgtaatttt

SEQ ID NO: 417 - DNA, 14 bp, Artificial Sequence
  Description of Artificial Sequence: antisense oligonucleotide
gaagtctgtaattt

SEQ ID NO: 418 - DNA, 14 bp, Artificial Sequence
  Description of Artificial Sequence: antisense oligonucleotide
atgtagacatcaat

SEQ ID NO: 419 - DNA, 14 bp, Artificial Sequence
  Description of Artificial Sequence: antisense oligonucleotide
atcatccaacattt

SEQ ID NO: 420 - DNA, 15 bp, Artificial Sequence
  Description of Artificial Sequence: antisense oligonucleotide
aatcatccaacattt

SEQ ID NO: 421 - DNA, 14 bp, Artificial Sequence
  Description of Artificial Sequence: antisense oligonucleotide
aatcatccaacatt

SEQ ID NO: 422 - DNA, 14 bp, Artificial Sequence
  Description of Artificial Sequence: antisense oligonucleotide
accatcaaatacat

SEQ ID NO: 423 - DNA, 14 bp, Artificial Sequence
  Description of Artificial Sequence: antisense oligonucleotide
aaaaacgtctttga

SEQ ID NO: 424 - DNA, 15 bp, Artificial Sequence
  Description of Artificial Sequence: antisense oligonucleotide
ttttgttcttagaca

SEQ ID NO: 425 - DNA, 14 bp, Artificial Sequence
  Description of Artificial Sequence: antisense oligonucleotide
ttttgttcttagac

SEQ ID NO: 426 - DNA, 14 bp, Artificial Sequence
  Description of Artificial Sequence: antisense oligonucleotide
taaacagaaaagca

SEQ ID NO: 427 - DNA, 14 bp, Artificial Sequence
  Description of Artificial Sequence: antisense oligonucleotide
actaaacagaaaag

SEQ ID NO: 428 - DNA, 16 bp, Artificial Sequence
  Description of Artificial Sequence: antisense oligonucleotide
aaactaaacagaaaag

SEQ ID NO: 429 - DNA, 14 bp, Artificial Sequence
  Description of Artificial Sequence: antisense oligonucleotide
aactaaacagaaaa

SEQ ID NO: 430 - DNA, 15 bp, Artificial Sequence
  Description of Artificial Sequence: antisense oligonucleotide
aaactaaacagaaaa

SEQ ID NO: 431 - DNA, 14 bp, Artificial Sequence
  Description of Artificial Sequence: antisense oligonucleotide
aaactaaacagaaa

SEQ ID NO: 432 - DNA, 17 bp, Artificial Sequence
  Description of Artificial Sequence: antisense oligonucleotide
taaaaactaaacagaaa

SEQ ID NO: 433 - DNA, 14 bp, Artificial Sequence
  Description of Artificial Sequence: antisense oligonucleotide
aaaactaaacagaa

SEQ ID NO: 434 - DNA, 17 bp, Artificial Sequence
  Description of Artificial Sequence: antisense oligonucleotide
gtaaaaactaaacagaa

SEQ ID NO: 435 - DNA, 14 bp, Artificial Sequence
  Description of Artificial Sequence: antisense oligonucleotide
aaaaactaaacaga

SEQ ID NO: 436 - DNA, 15 bp, Artificial Sequence
  Description of Artificial Sequence: antisense oligonucleotide
taaaaactaaacaga

SEQ ID NO: 437 - DNA, 14 bp, Artificial Sequence
  Description of Artificial Sequence: antisense oligonucleotide
taaaaactaaacag

SEQ ID NO: 438 - DNA, 14 bp, Artificial Sequence
  Description of Artificial Sequence: antisense oligonucleotide
gtaaaaactaaaca

SEQ ID NO: 439 - DNA, 19 bp, Artificial Sequence
  Description of Artificial Sequence: antisense oligonucleotide
aaaaagtaaaaactaaaca

SEQ ID NO: 440 - DNA, 14 bp, Artificial Sequence
  Description of Artificial Sequence: antisense oligonucleotide
agtaaaaactaaac

SEQ ID NO: 441 - DNA, 20 bp, Artificial Sequence
  Description of Artificial Sequence: antisense oligonucleotide
aaaaaaagtaaaaactaaac

SEQ ID NO: 442 - DNA, 14 bp, Artificial Sequence
  Description of Artificial Sequence: antisense oligonucleotide
aagtaaaaactaaa

SEQ ID NO: 443 - DNA, 19 bp, Artificial Sequence
  Description of Artificial Sequence: antisense oligonucleotide
aaaaaaagtaaaaactaaa

SEQ ID NO: 444 - DNA, 14 bp, Artificial Sequence
  Description of Artificial Sequence: antisense oligonucleotide
aaagtaaaaactaa

SEQ ID NO: 445 - DNA, 14 bp, Artificial Sequence
  Description of Artificial Sequence: antisense oligonucleotide
aaaagtaaaaacta

SEQ ID NO: 446 - DNA, 17 bp, Artificial Sequence
  Description of Artificial Sequence: antisense oligonucleotide
aaaaaaagtaaaaacta

SEQ ID NO: 447 - DNA, 14 bp, Artificial Sequence
  Description of Artificial Sequence: antisense oligonucleotide
aaaaagtaaaaact

SEQ ID NO: 448 - DNA, 16 bp, Artificial Sequence
  Description of Artificial Sequence: antisense oligonucleotide
aaaaaaagtaaaaact

SEQ ID NO: 449 - DNA, 15 bp, Artificial Sequence
  Description of Artificial Sequence: antisense oligonucleotide
aaaaaaagtaaaaac

SEQ ID NO: 450 - DNA, 16 bp, Artificial Sequence
  Description of Artificial Sequence: antisense oligonucleotide
caaaaaaagtaaaaac

SEQ ID NO: 451 - DNA, 14 bp, Artificial Sequence
  Description of Artificial Sequence: antisense oligonucleotide
aaaaaaagtaaaaa

SEQ ID NO: 452 - DNA, 14 bp, Artificial Sequence
  Description of Artificial Sequence: antisense oligonucleotide
caaaaaaagtaaaa

SEQ ID NO: 453 - DNA, 20 bp, Artificial Sequence
  Description of Artificial Sequence: antisense oligonucleotide
aacaaaacaaaaaaagtaaa

SEQ ID NO: 454 - DNA, 14 bp, Artificial Sequence
  Description of Artificial Sequence: antisense oligonucleotide
aaacaaaaaaagta

SEQ ID NO: 455 - DNA, 16 bp, Artificial Sequence
  Description of Artificial Sequence: antisense oligonucleotide
caaaacaaaaaaagta

SEQ ID NO: 456 - DNA, 15 bp, Artificial Sequence
  Description of Artificial Sequence: antisense oligonucleotide
caaaacaaaaaaagt

SEQ ID NO: 457 - DNA, 14 bp, Artificial Sequence
  Description of Artificial Sequence: antisense oligonucleotide
caaaacaaaaaaag

SEQ ID NO: 458 - DNA, 17 bp, Artificial Sequence
  Description of Artificial Sequence: antisense oligonucleotide
ctttaaaaaaacaaaac

SEQ ID NO: 459 - DNA, 16 bp, Artificial Sequence
  Description of Artificial Sequence: antisense oligonucleotide
tctttaaaaaaacaaa

SEQ ID NO: 460 - DNA, 17 bp, Artificial Sequence
  Description of Artificial Sequence: antisense oligonucleotide
gtctttaaaaaaacaaa

SEQ ID NO: 461 - DNA, 15 bp, Artificial Sequence
  Description of Artificial Sequence: antisense oligonucleotide
gtctttaaaaaaaca

SEQ ID NO: 462 - DNA, 14 bp, Artificial Sequence
  Description of Artificial Sequence: antisense oligonucleotide
gtctttaaaaaaac

SEQ ID NO: 463 - DNA, 14 bp, Artificial Sequence
  Description of Artificial Sequence: antisense oligonucleotide
tttatttcgtcttt

SEQ ID NO: 464 - DNA, 14 bp, Artificial Sequence
  Description of Artificial Sequence: antisense oligonucleotide
tctttatttcgtct

SEQ ID NO: 465 - DNA, 14 bp, Artificial Sequence
  Description of Artificial Sequence: antisense oligonucleotide
tatttgcaaatgga

SEQ ID NO: 466 - DNA, 15 bp, Artificial Sequence
  Description of Artificial Sequence: antisense oligonucleotide
tatatttgcaaatgg

SEQ ID NO: 467 - DNA, 14 bp, Artificial Sequence
  Description of Artificial Sequence: antisense oligonucleotide
tatatttgcaaatg

SEQ ID NO: 468 - DNA, 19 bp, Artificial Sequence
  Description of Artificial Sequence: antisense oligonucleotide
caaaatatatttgcaaatg

SEQ ID NO: 469 - DNA, 18 bp, Artificial Sequence
  Description of Artificial Sequence: antisense oligonucleotide
caaaatatatttgcaaat

SEQ ID NO: 470 - DNA, 15 bp, Artificial Sequence
  Description of Artificial Sequence: antisense oligonucleotide
caaaatatatttgca

SEQ ID NO: 471 - DNA, 14 bp, Artificial Sequence
  Description of Artificial Sequence: antisense oligonucleotide
caaaatatatttgc

SEQ ID NO: 472 - DNA, 16 bp, Artificial Sequence
  Description of Artificial Sequence: antisense oligonucleotide
ttccaaaatatatttg

SEQ ID NO: 473 - DNA, 17 bp, Artificial Sequence
  Description of Artificial Sequence: antisense oligonucleotide
ttttccaaaatatattt

SEQ ID NO: 474 - DNA, 17 bp, Artificial Sequence
  Description of Artificial Sequence: antisense oligonucleotide
gttttccaaaatatatt

SEQ ID NO: 475 - DNA, 14 bp, Artificial Sequence
  Description of Artificial Sequence: antisense oligonucleotide
gttttccaaaatat

SEQ ID NO: 476 - DNA, 14 bp, Artificial Sequence
  Description of Artificial Sequence: antisense oligonucleotide
ggttaggcaaagcc

SEQ ID NO: 477 - DNA, 18 bp, Artificial Sequence
  Description of Artificial Sequence: antisense oligonucleotide
ccgagaacatcatcgtgg

SEQ ID NO: 478 - DNA, 17 bp, Artificial Sequence
  Description of Artificial Sequence: antisense oligonucleotide
ccgagaacatcatcgtg

SEQ ID NO: 479 - DNA, 15 bp, Artificial Sequence
  Description of Artificial Sequence: antisense oligonucleotide
ccgagaacatcatcg

SEQ ID NO: 480 - DNA, 18 bp, Artificial Sequence
  Description of Artificial Sequence: antisense oligonucleotide
cgtagtctgcgttgaagc

SEQ ID NO: 481 - DNA, 15 bp, Artificial Sequence
  Description of Artificial Sequence: antisense oligonucleotide
ccatgctggagaagg

SEQ ID NO: 482 - DNA, 14 bp, Artificial Sequence
  Description of Artificial Sequence: antisense oligonucleotide
ccgtgcagaagtcc

SEQ ID NO: 483 - DNA, 14 bp, Artificial Sequence
  Description of Artificial Sequence: antisense oligonucleotide
ggaatgaagttggc

SEQ ID NO: 484 - DNA, 14 bp, Artificial Sequence
  Description of Artificial Sequence: antisense oligonucleotide
tgaccgtgggaatg

SEQ ID NO: 485 - DNA, 14 bp, Artificial Sequence
  Description of Artificial Sequence: antisense oligonucleotide
tggcagtgaccgtg

SEQ ID NO: 486 - DNA, 14 bp, Artificial Sequence
  Description of Artificial Sequence: antisense oligonucleotide
agatggcagtgacc

SEQ ID NO: 487 - DNA, 16 bp, Artificial Sequence
  Description of Artificial Sequence: antisense oligonucleotide
cgagatggcagtgacc

SEQ ID NO: 488 - DNA, 14 bp, Artificial Sequence
  Description of Artificial Sequence: antisense oligonucleotide
ccagccactgcagg

SEQ ID NO: 489 - DNA, 14 bp, Artificial Sequence
  Description of Artificial Sequence: antisense oligonucleotide
gcaccagccactgc

SEQ ID NO: 490 - DNA, 14 bp, Artificial Sequence
  Description of Artificial Sequence: antisense oligonucleotide
ccctggagtaagcc

SEQ ID NO: 491 - DNA, 18 bp, Artificial Sequence
  Description of Artificial Sequence: antisense oligonucleotide
ggagataactgttccacc

SEQ ID NO: 492 - DNA, 15 bp, Artificial Sequence
  Description of Artificial Sequence: antisense oligonucleotide
ggagataactgttcc

SEQ ID NO: 493 - DNA, 15 bp, Artificial Sequence
  Description of Artificial Sequence: antisense oligonucleotide
cttctagttggtctg

SEQ ID NO: 494 - DNA, 14 bp, Artificial Sequence
  Description of Artificial Sequence: antisense oligonucleotide
catcttctagttgg

SEQ ID NO: 495 - DNA, 17 bp, Artificial Sequence
  Description of Artificial Sequence: antisense oligonucleotide
tctcatcttctagttgg

SEQ ID NO: 496 - DNA, 18 bp, Artificial Sequence
  Description of Artificial Sequence: antisense oligonucleotide
ctgcaaagcagacttctc

SEQ ID NO: 497 - DNA, 15 bp, Artificial Sequence
  Description of Artificial Sequence: antisense oligonucleotide
ccttcagcaggttgg

SEQ ID NO: 498 - DNA, 14 bp, Artificial Sequence
  Description of Artificial Sequence: antisense oligonucleotide
cccaggtcatcagg

SEQ ID NO: 499 - DNA, 15 bp, Artificial Sequence
  Description of Artificial Sequence: antisense oligonucleotide
ccagtcagatcaagg

SEQ ID NO: 500 - DNA, 15 bp, Artificial Sequence
  Description of Artificial Sequence: antisense oligonucleotide
ggtgaaggcctcctc

SEQ ID NO: 501 - DNA, 15 bp, Artificial Sequence
  Description of Artificial Sequence: antisense oligonucleotide
cagggtgaaggcctc

SEQ ID NO: 502 - DNA, 15 bp, Artificial Sequence
  Description of Artificial Sequence: antisense oligonucleotide
cctggatgatgctgg

SEQ ID NO: 503 - DNA, 14 bp, Artificial Sequence
  Description of Artificial Sequence: antisense oligonucleotide
ccactgtgcagagg

SEQ ID NO: 504 - DNA, 15 bp, Artificial Sequence
  Description of Artificial Sequence: antisense oligonucleotide
ggagtacaggtgacc

SEQ ID NO: 505 - DNA, 15 bp, Artificial Sequence
  Description of Artificial Sequence: antisense oligonucleotide
gctcattgctgctgc

SEQ ID NO: 506 - DNA, 17 bp, Artificial Sequence
  Description of Artificial Sequence: antisense oligonucleotide
ggaaggctcattgctgc

SEQ ID NO: 507 - DNA, 14 bp, Artificial Sequence
  Description of Artificial Sequence: antisense oligonucleotide
ttttctcttcttct

SEQ ID NO: 508 - DNA, 14 bp, Artificial Sequence
  Description of Artificial Sequence: antisense oligonucleotide
atcttattcctttc

SEQ ID NO: 509 - DNA, 14 bp, Artificial Sequence
  Description of Artificial Sequence: antisense oligonucleotide
catcttattccttt

SEQ ID NO: 510 - DNA, 14 bp, Artificial Sequence
  Description of Artificial Sequence: antisense oligonucleotide
tagtttttccttct

SEQ ID NO: 511 - DNA, 14 bp, Artificial Sequence
  Description of Artificial Sequence: antisense oligonucleotide
tctagtttttcctt

SEQ ID NO: 512 - DNA, 14 bp, Artificial Sequence
  Description of Artificial Sequence: antisense oligonucleotide
aactctagtttttc

SEQ ID NO: 513 - DNA, 14 bp, Artificial Sequence
  Description of Artificial Sequence: antisense oligonucleotide
gaactctagttttt

SEQ ID NO: 514 - DNA, 15 bp, Artificial Sequence
  Description of Artificial Sequence: antisense oligonucleotide
tgaactctagttttt

SEQ ID NO: 515 - DNA, 16 bp, Artificial Sequence
  Description of Artificial Sequence: antisense oligonucleotide
atgaactctagttttt

SEQ ID NO: 516 - DNA, 14 bp, Artificial Sequence
  Description of Artificial Sequence: antisense oligonucleotide
tgaactctagtttt

SEQ ID NO: 517 - DNA, 15 bp, Artificial Sequence
  Description of Artificial Sequence: antisense oligonucleotide
atgaactctagtttt

SEQ ID NO: 518 - DNA, 14 bp, Artificial Sequence
  Description of Artificial Sequence: antisense oligonucleotide
atgaactctagttt

SEQ ID NO: 519 - DNA, 14 bp, Artificial Sequence
  Description of Artificial Sequence: antisense oligonucleotide
gcacacagtagtgc

SEQ ID NO: 520 - DNA, 16 bp, Artificial Sequence
  Description of Artificial Sequence: antisense oligonucleotide
gcaggatcagaaaagc

SEQ ID NO: 521 - DNA, 14 bp, Artificial Sequence
  Description of Artificial Sequence: antisense oligonucleotide
gcaggtagacaggc

SEQ ID NO: 522 - DNA, 17 bp, Artificial Sequence
  Description of Artificial Sequence: antisense oligonucleotide
gcttgctcaggatctgc

SEQ ID NO: 523 - DNA, 15 bp, Artificial Sequence
  Description of Artificial Sequence: antisense oligonucleotide
gcaagtccctggtgc

SEQ ID NO: 524 - DNA, 14 bp, Artificial Sequence
  Description of Artificial Sequence: antisense oligonucleotide
cctggagcaagtcc

SEQ ID NO: 525 - DNA, 17 bp, Artificial Sequence
  Description of Artificial Sequence: antisense oligonucleotide
cgtagtactcttcgtcg

SEQ ID NO: 526 - DNA, 14 bp, Artificial Sequence
  Description of Artificial Sequence: antisense oligonucleotide
cgtagtactcttcg

SEQ ID NO: 527 - DNA, 14 bp, Artificial Sequence
  Description of Artificial Sequence: antisense oligonucleotide
gtaaacctccttgg

SEQ ID NO: 528 - DNA, 19 bp, Artificial Sequence
  Description of Artificial Sequence: antisense oligonucleotide
gtctattttgtaaacctcc

SEQ ID NO: 529 - DNA, 20 bp, Artificial Sequence
  Description of Artificial Sequence: antisense oligonucleotide
gcatgtctattttgtaaacc

SEQ ID NO: 530 - DNA, 15 bp, Artificial Sequence
  Description of Artificial Sequence: antisense oligonucleotide
ggcatcaaggtaccc

SEQ ID NO: 531 - DNA, 14 bp, Artificial Sequence
  Description of Artificial Sequence: antisense oligonucleotide
ggcatcaaggtacc

SEQ ID NO: 532 - DNA, 20 bp, Artificial Sequence
  Description of Artificial Sequence: antisense oligonucleotide
gctttcaccaaattggaagc

SEQ ID NO: 533 - DNA, 18 bp, Artificial Sequence
  Description of Artificial Sequence: antisense oligonucleotide
gagaatctgatatagctc

SEQ ID NO: 534 - DNA, 19 bp, Artificial Sequence
  Description of Artificial Sequence: antisense oligonucleotide
ggagatgttaaatctttgg

SEQ ID NO: 535 - DNA, 14 bp, Artificial Sequence
  Description of Artificial Sequence: antisense oligonucleotide
gctgtcgatgtagc

SEQ ID NO: 536 - DNA, 20 bp, Artificial Sequence
  Description of Artificial Sequence: antisense oligonucleotide
ccaggttcctgtctttatgg

SEQ ID NO: 537 - DNA, 14 bp, Artificial Sequence
  Description of Artificial Sequence: antisense oligonucleotide
cagcagggacagtg

SEQ ID NO: 538 - DNA, 19 bp, Artificial Sequence
  Description of Artificial Sequence: antisense oligonucleotide
cttgcttctagttcttcac

SEQ ID NO: 539 - DNA, 15 bp, Artificial Sequence
  Description of Artificial Sequence: antisense oligonucleotide
gccatcaatacctgc

SEQ ID NO: 540 - DNA, 15 bp, Artificial Sequence
  Description of Artificial Sequence: antisense oligonucleotide
ggtgccatcaatacc

SEQ ID NO: 541 - DNA, 16 bp, Artificial Sequence
  Description of Artificial Sequence: antisense oligonucleotide
ccactggtatatgtgg

SEQ ID NO: 542 - DNA, 18 bp, Artificial Sequence
  Description of Artificial Sequence: antisense oligonucleotide
ggactttatagttttctg

SEQ ID NO: 543 - DNA, 16 bp, Artificial Sequence
  Description of Artificial Sequence: antisense oligonucleotide
ctcaagtctgtaggag

SEQ ID NO: 544 - DNA, 15 bp, Artificial Sequence
  Description of Artificial Sequence: antisense oligonucleotide
ggtctgttgtgactc

SEQ ID NO: 545 - DNA, 19 bp, Artificial Sequence
  Description of Artificial Sequence: antisense oligonucleotide
caattatcctgcacatttc

SEQ ID NO: 546 - DNA, 16 bp, Artificial Sequence
  Description of Artificial Sequence: antisense oligonucleotide
gcagcaattatcctgc

SEQ ID NO: 547 - DNA, 14 bp, Artificial Sequence
  Description of Artificial Sequence: antisense oligonucleotide
ggcagcaattatcc

SEQ ID NO: 548 - DNA, 19 bp, Artificial Sequence
  Description of Artificial Sequence: antisense oligonucleotide
ggttcgtgtatccatttcc

SEQ ID NO: 549 - DNA, 14 bp, Artificial Sequence
  Description of Artificial Sequence: antisense oligonucleotide
gcacagaagttggc

SEQ ID NO: 550 - DNA, 16 bp, Artificial Sequence
  Description of Artificial Sequence: antisense oligonucleotide
ccagcacagaagttgg

SEQ ID NO: 551 - DNA, 14 bp, Artificial Sequence
  Description of Artificial Sequence: antisense oligonucleotide
gtgctgagtgtctg

SEQ ID NO: 552 - DNA, 16 bp, Artificial Sequence
  Description of Artificial Sequence: antisense oligonucleotide
cctgctgtgctgagtg

SEQ ID NO: 553 - DNA, 14 bp, Artificial Sequence
  Description of Artificial Sequence: antisense oligonucleotide
gctcaggaccctgc

SEQ ID NO: 554 - DNA, 15 bp, Artificial Sequence
  Description of Artificial Sequence: antisense oligonucleotide
gcagcaaggagaagc

SEQ ID NO: 555 - DNA, 19 bp, Artificial Sequence
  Description of Artificial Sequence: antisense oligonucleotide
ccaatgtagtagagaatgg

SEQ ID NO: 556 - DNA, 14 bp, Artificial Sequence
  Description of Artificial Sequence: antisense oligonucleotide
gctgcatttgcaag

SEQ ID NO: 557 - DNA, 14 bp, Artificial Sequence
  Description of Artificial Sequence: antisense oligonucleotide
aaaaaagaaatcaa

SEQ ID NO: 558 - DNA, 15 bp, Artificial Sequence
  Description of Artificial Sequence: antisense oligonucleotide
aaaaaaagaaatcaa

SEQ ID NO: 559 - DNA, 16 bp, Artificial Sequence
  Description of Artificial Sequence: antisense oligonucleotide
aaaaaaaagaaatcaa

SEQ ID NO: 560 - DNA, 17 bp, Artificial Sequence
  Description of Artificial Sequence: antisense oligonucleotide
taaaaaaaagaaatcaa

SEQ ID NO: 561 - DNA, 18 bp, Artificial Sequence
  Description of Artificial Sequence: antisense oligonucleotide
ataaaaaaaagaaatcaa

SEQ ID NO: 562 - DNA, 19 bp, Artificial Sequence
  Description of Artificial Sequence: antisense oligonucleotide
aataaaaaaaagaaatcaa

SEQ ID NO: 563 - DNA, 17 bp, Artificial Sequence
  Description of Artificial Sequence: antisense oligonucleotide
gaataaaaaaaagaaat

SEQ ID NO: 564 - DNA, 18 bp, Artificial Sequence
  Description of Artificial Sequence: antisense oligonucleotide
agaataaaaaaaagaaat

SEQ ID NO: 565 - DNA, 14 bp, Artificial Sequence
  Description of Artificial Sequence: antisense oligonucleotide
cagaataaaaaaaa

SEQ ID NO: 566 - DNA, 14 bp, Artificial Sequence
  Description of Artificial Sequence: antisense oligonucleotide
tcagaataaaaaaa

SEQ ID NO: 567 - DNA, 14 bp, Artificial Sequence
  Description of Artificial Sequence: antisense oligonucleotide
ttgtttttaaaagt

SEQ ID NO: 568 - DNA, 14 bp, Artificial Sequence
  Description of Artificial Sequence: antisense oligonucleotide
agttgtttttaaaa

SEQ ID NO: 569 - DNA, 15 bp, Artificial Sequence
  Description of Artificial Sequence: antisense oligonucleotide
aagttgtttttaaaa

SEQ ID NO: 570 - DNA, 16 bp, Artificial Sequence
  Description of Artificial Sequence: antisense oligonucleotide
aaagttgtttttaaaa

SEQ ID NO: 571 - DNA, 17 bp, Artificial Sequence
  Description of Artificial Sequence: antisense oligonucleotide
aaaagttgtttttaaaa

SEQ ID NO: 572 - DNA, 18 bp, Artificial Sequence
  Description of Artificial Sequence: antisense oligonucleotide
aaaaagttgtttttaaaa

SEQ ID NO: 573 - DNA, 19 bp, Artificial Sequence
  Description of Artificial Sequence: antisense oligonucleotide
aaaaaagttgtttttaaaa

SEQ ID NO: 574 - DNA, 20 bp, Artificial Sequence
  Description of Artificial Sequence: antisense oligonucleotide
aaaaaaagttgtttttaaaa

SEQ ID NO: 575 - DNA, 20 bp, Artificial Sequence
  Description of Artificial Sequence: antisense oligonucleotide
aaaaaaaagttgtttttaaa

SEQ ID NO: 576 - DNA, 14 bp, Artificial Sequence
  Description of Artificial Sequence: antisense oligonucleotide
tttttaaaaaagtg

SEQ ID NO: 577 - DNA, 15 bp, Artificial Sequence
  Description of Artificial Sequence: antisense oligonucleotide
ttttttaaaaaagtg

SEQ ID NO: 578 - DNA, 16 bp, Artificial Sequence
  Description of Artificial Sequence: antisense oligonucleotide
attttttaaaaaagtg

SEQ ID NO: 579 - DNA, 16 bp, Artificial Sequence
  Description of Artificial Sequence: antisense oligonucleotide
cattttttaaaaaagt

SEQ ID NO: 580 - DNA, 15 bp, Artificial Sequence
  Description of Artificial Sequence: antisense oligonucleotide
gcattttttaaaaaa

SEQ ID NO: 581 - DNA, 16 bp, Artificial Sequence
  Description of Artificial Sequence: antisense oligonucleotide
tgcattttttaaaaaa

SEQ ID NO: 582 - DNA, 14 bp, Artificial Sequence
  Description of Artificial Sequence: antisense oligonucleotide
agcttattttaaat

SEQ ID NO: 583 - DNA, 15 bp, Artificial Sequence
  Description of Artificial Sequence: antisense oligonucleotide
aagcttattttaaat

SEQ ID NO: 584 - DNA, 16 bp, Artificial Sequence
  Description of Artificial Sequence: antisense oligonucleotide
taagcttattttaaat

SEQ ID NO: 585 - DNA, 14 bp, Artificial Sequence
  Description of Artificial Sequence: antisense oligonucleotide
tgtaattattagat

SEQ ID NO: 586 - DNA, 15 bp, Artificial Sequence
  Description of Artificial Sequence: antisense oligonucleotide
atgtaattattagat

SEQ ID NO: 587 - DNA, 14 bp, Artificial Sequence
  Description of Artificial Sequence: antisense oligonucleotide
tgatgtaattatta

SEQ ID NO: 588 - DNA, 15 bp, Artificial Sequence
  Description of Artificial Sequence: antisense oligonucleotide
atgatgtaattatta

SEQ ID NO: 589 - DNA, 14 bp, Artificial Sequence
  Description of Artificial Sequence: antisense oligonucleotide
atggtattatataa

SEQ ID NO: 590 - DNA, 15 bp, Artificial Sequence
  Description of Artificial Sequence: antisense oligonucleotide
tatggtattatataa

SEQ ID NO: 591 - DNA, 16 bp, Artificial Sequence
  Description of Artificial Sequence: antisense oligonucleotide
ttatggtattatataa

SEQ ID NO: 592 - DNA, 17 bp, Artificial Sequence
  Description of Artificial Sequence: antisense oligonucleotide
tttatggtattatataa

SEQ ID NO: 593 - DNA, 18 bp, Artificial Sequence
  Description of Artificial Sequence: antisense oligonucleotide
atttatggtattatataa

SEQ ID NO: 594 - DNA, 14 bp, Artificial Sequence
  Description of Artificial Sequence: antisense oligonucleotide
aatcatattagaaa

SEQ ID NO: 595 - DNA, 14 bp, Artificial Sequence
  Description of Artificial Sequence: antisense oligonucleotide
ttacaatcatatta

SEQ ID NO: 596 - DNA, 15 bp, Artificial Sequence
  Description of Artificial Sequence: antisense oligonucleotide
tttacaatcatatta

SEQ ID NO: 597 - DNA, 16 bp, Artificial Sequence
  Description of Artificial Sequence: antisense oligonucleotide
ggcatgacgcctttcc

SEQ ID NO: 598 - DNA, 14 bp, Artificial Sequence
  Description of Artificial Sequence: antisense oligonucleotide
gcatgacgcctttc

SEQ ID NO: 599 - DNA, 14 bp, Artificial Sequence
  Description of Artificial Sequence: antisense oligonucleotide
gcctgacgagaggc

SEQ ID NO: 600 - DNA, 15 bp, Artificial Sequence
  Description of Artificial Sequence: antisense oligonucleotide
ctcaagcctgacgag

SEQ ID NO: 601 - DNA, 16 bp, Artificial Sequence
  Description of Artificial Sequence: antisense oligonucleotide
ccacagttcctttttc

SEQ ID NO: 602 - DNA, 18 bp, Artificial Sequence
  Description of Artificial Sequence: antisense oligonucleotide
gctgcaataaagatacag

SEQ ID NO: 603 - DNA, 16 bp, Artificial Sequence
  Description of Artificial Sequence: antisense oligonucleotide
gctgcaataaagatac

SEQ ID NO: 604 - DNA, 17 bp, Artificial Sequence
  Description of Artificial Sequence: antisense oligonucleotide
ggacactgatttctatg

SEQ ID NO: 605 - DNA, 16 bp, Artificial Sequence
  Description of Artificial Sequence: antisense oligonucleotide
gcattatcaactttgg

SEQ ID NO: 606 - DNA, 16 bp, Artificial Sequence
  Description of Artificial Sequence: antisense oligonucleotide
acttttagcaccaatg

SEQ ID NO: 607 - DNA, 19 bp, Artificial Sequence
  Description of Artificial Sequence: antisense oligonucleotide
ccaagaaacttttagcacc

SEQ ID NO: 608 - DNA, 14 bp, Artificial Sequence
  Description of Artificial Sequence: antisense oligonucleotide
ccagatcatcttcc

SEQ ID NO: 609 - DNA, 16 bp, Artificial Sequence
  Description of Artificial Sequence: antisense oligonucleotide
agtcaaggacacatag

SEQ ID NO: 610 - DNA, 16 bp, Artificial Sequence
  Description of Artificial Sequence: antisense oligonucleotide
tctttgagcaacatgg

SEQ ID NO: 611 - DNA, 14 bp, Artificial Sequence
  Description of Artificial Sequence: antisense oligonucleotide
gggtataacagctg

SEQ ID NO: 612 - DNA, 18 bp, Artificial Sequence
  Description of Artificial Sequence: antisense oligonucleotide
gaggtgaaccattaatgg

SEQ ID NO: 613 - DNA, 16 bp, Artificial Sequence
  Description of Artificial Sequence: antisense oligonucleotide
tcttcgtatcgtttag

SEQ ID NO: 614 - DNA, 15 bp, Artificial Sequence
  Description of Artificial Sequence: antisense oligonucleotide
tgttggatagtgttc

SEQ ID NO: 615 - DNA, 15 bp, Artificial Sequence
  Description of Artificial Sequence: antisense oligonucleotide
gttgatcacttgctg

SEQ ID NO: 616 - DNA, 15 bp, Artificial Sequence
  Description of Artificial Sequence: antisense oligonucleotide
ggattccattactcg

SEQ ID NO: 617 - DNA, 20 bp, Artificial Sequence
  Description of Artificial Sequence: antisense oligonucleotide
gacatatgaaaaatgttgtc

SEQ ID NO: 618 - DNA, 17 bp, Artificial Sequence
  Description of Artificial Sequence: antisense oligonucleotide
gccaataaagacatatg

SEQ ID NO: 619 - DNA, 17 bp, Artificial Sequence
  Description of Artificial Sequence: antisense oligonucleotide
ccagaatcaagattctg

SEQ ID NO: 620 - DNA, 16 bp, Artificial Sequence
  Description of Artificial Sequence: antisense oligonucleotide
ctgttccagaatcaag

SEQ ID NO: 621 - DNA, 20 bp, Artificial Sequence
  Description of Artificial Sequence: antisense oligonucleotide
gacaaatctgttccagaatc

SEQ ID NO: 622 - DNA, 19 bp, Artificial Sequence
  Description of Artificial Sequence: antisense oligonucleotide
ggaaagacaaatctgttcc

SEQ ID NO: 623 - DNA, 16 bp, Artificial Sequence
  Description of Artificial Sequence: antisense oligonucleotide
gattaagaggacaagc

SEQ ID NO: 624 - DNA, 14 bp, Artificial Sequence
  Description of Artificial Sequence: antisense oligonucleotide
ggaagattaagagg

SEQ ID NO: 625 - DNA, 18 bp, Artificial Sequence
  Description of Artificial Sequence: antisense oligonucleotide
gcagtgtgattattctgg

SEQ ID NO: 626 - DNA, 19 bp, Artificial Sequence
  Description of Artificial Sequence: antisense oligonucleotide
ggagaaagatacatatctg

SEQ ID NO: 627 - DNA, 14 bp, Artificial Sequence
  Description of Artificial Sequence: antisense oligonucleotide
ggagatcttacagg

SEQ ID NO: 628 - DNA, 20 bp, Artificial Sequence
  Description of Artificial Sequence: antisense oligonucleotide
gcatttgcagtagaatttac

SEQ ID NO: 629 - DNA, 14 bp, Artificial Sequence
  Description of Artificial Sequence: antisense oligonucleotide
cagtgaaagagagg

SEQ ID NO: 630 - DNA, 14 bp, Artificial Sequence
  Description of Artificial Sequence: antisense oligonucleotide
gctagccgatacac

SEQ ID NO: 631 - DNA, 17 bp, Artificial Sequence
  Description of Artificial Sequence: antisense oligonucleotide
ggaagatccttgtatgc

SEQ ID NO: 632 - DNA, 15 bp, Artificial Sequence
  Description of Artificial Sequence: antisense oligonucleotide
gcatgaggaagatcc

SEQ ID NO: 633 - DNA, 16 bp, Artificial Sequence
  Description of Artificial Sequence: antisense oligonucleotide
ggagtcatttttgttg

SEQ ID NO: 634 - DNA, 19 bp, Artificial Sequence
  Description of Artificial Sequence: antisense oligonucleotide
ccaattgatactaagattc

SEQ ID NO: 635 - DNA, 15 bp, Artificial Sequence
  Description of Artificial Sequence: antisense oligonucleotide
tcttttgagcacacg

SEQ ID NO: 636 - DNA, 18 bp, Artificial Sequence
  Description of Artificial Sequence: antisense oligonucleotide
ccttcagcacttcttttg

SEQ ID NO: 637 - DNA, 16 bp, Artificial Sequence
  Description of Artificial Sequence: antisense oligonucleotide
ggttgcttccttcagc

SEQ ID NO: 638 - DNA, 14 bp, Artificial Sequence
  Description of Artificial Sequence: antisense oligonucleotide
cagtggtttaggag

SEQ ID NO: 639 - DNA, 17 bp, Artificial Sequence
  Description of Artificial Sequence: antisense oligonucleotide
cctgagatcctcatttc

SEQ ID NO: 640 - DNA, 17 bp, Artificial Sequence
  Description of Artificial Sequence: antisense oligonucleotide
ccaaggtcctgagatcc

SEQ ID NO: 641 - DNA, 16 bp, Artificial Sequence
  Description of Artificial Sequence: antisense oligonucleotide
ggtgtacacagtgtcc

SEQ ID NO: 642 - DNA, 14 bp, Artificial Sequence
  Description of Artificial Sequence: antisense oligonucleotide
tatctttaatttct

SEQ ID NO: 643 - DNA, 14 bp, Artificial Sequence
  Description of Artificial Sequence: antisense oligonucleotide
tcttttgaatataa

SEQ ID NO: 644 - DNA, 15 bp, Artificial Sequence
  Description of Artificial Sequence: antisense oligonucleotide
ttcttttgaatataa

SEQ ID NO: 645 - DNA, 16 bp, Artificial Sequence
  Description of Artificial Sequence: antisense oligonucleotide
tttcttttgaatataa

SEQ ID NO: 646 - DNA, 17 bp, Artificial Sequence
  Description of Artificial Sequence: antisense oligonucleotide
ttttcttttgaatataa

SEQ ID NO: 647 - DNA, 18 bp, Artificial Sequence
  Description of Artificial Sequence: antisense oligonucleotide
tttttcttttgaatataa

SEQ ID NO: 648 - DNA, 14 bp, Artificial Sequence
  Description of Artificial Sequence: antisense oligonucleotide
atttctatgttttt

SEQ ID NO: 649 - DNA, 14 bp, Artificial Sequence
  Description of Artificial Sequence: antisense oligonucleotide
ttaaagaatttatg

SEQ ID NO: 650 - DNA, 14 bp, Artificial Sequence
  Description of Artificial Sequence: antisense oligonucleotide
gttaaagaatttat

SEQ ID NO: 651 - DNA, 15 bp, Artificial Sequence
  Description of Artificial Sequence: antisense oligonucleotide
agttaaagaatttat

SEQ ID NO: 652 - DNA, 16 bp, Artificial Sequence
  Description of Artificial Sequence: antisense oligonucleotide
aagttaaagaatttat

SEQ ID NO: 653 - DNA, 17 bp, Artificial Sequence
  Description of Artificial Sequence: antisense oligonucleotide
taagttaaagaatttat

SEQ ID NO: 654 - DNA, 14 bp, Artificial Sequence
  Description of Artificial Sequence: antisense oligonucleotide
tttagtaagttaaa

SEQ ID NO: 655 - DNA, 15 bp, Artificial Sequence
  Description of Artificial Sequence: antisense oligonucleotide
ttttagtaagttaaa

SEQ ID NO: 656 - DNA, 14 bp, Artificial Sequence
  Description of Artificial Sequence: antisense oligonucleotide
atttcttttagtaa

SEQ ID NO: 657 - DNA, 15 bp, Artificial Sequence
  Description of Artificial Sequence: antisense oligonucleotide
aatttcttttagtaa

SEQ ID NO: 658 - DNA, 14 bp, Artificial Sequence
  Description of Artificial Sequence: antisense oligonucleotide
atcaatttctttta

SEQ ID NO: 659 - DNA, 15 bp, Artificial Sequence
  Description of Artificial Sequence: antisense oligonucleotide
tatcaatttctttta

SEQ ID NO: 660 - DNA, 14 bp, Artificial Sequence
  Description of Artificial Sequence: antisense oligonucleotide
aatatataagttca

SEQ ID NO: 661 - DNA, 15 bp, Artificial Sequence
  Description of Artificial Sequence: antisense oligonucleotide
aaatatataagttca

SEQ ID NO: 662 - DNA, 14 bp, Artificial Sequence
  Description of Artificial Sequence: antisense oligonucleotide
caaatatataagtt

SEQ ID NO: 663 - DNA, 15 bp, Artificial Sequence
  Description of Artificial Sequence: antisense oligonucleotide
tcaaatatataagtt

SEQ ID NO: 664 - DNA, 14 bp, Artificial Sequence
  Description of Artificial Sequence: antisense oligonucleotide
tgtcaaatatataa

SEQ ID NO: 665 - DNA, 14 bp, Artificial Sequence
  Description of Artificial Sequence: antisense oligonucleotide
aatttatttcagta

SEQ ID NO: 666 - DNA, 14 bp, Artificial Sequence
  Description of Artificial Sequence: antisense oligonucleotide
aataaaaatgtgat

SEQ ID NO: 667 - DNA, 15 bp, Artificial Sequence
  Description of Artificial Sequence: antisense oligonucleotide
taataaaaatgtgat

SEQ ID NO: 668 - DNA, 14 bp, Artificial Sequence
  Description of Artificial Sequence: antisense oligonucleotide
tagctaataaaaat

SEQ ID NO: 669 - DNA, 15 bp, Artificial Sequence
  Description of Artificial Sequence: antisense oligonucleotide
ttagctaataaaaat

SEQ ID NO: 670 - DNA, 16 bp, Artificial Sequence
  Description of Artificial Sequence: antisense oligonucleotide
tttagctaataaaaat

SEQ ID NO: 671 - DNA, 14 bp, Artificial Sequence
  Description of Artificial Sequence: antisense oligonucleotide
aataaaatagtcaa

SEQ ID NO: 672 - DNA, 15 bp, Artificial Sequence
  Description of Artificial Sequence: antisense oligonucleotide
taataaaatagtcaa

SEQ ID NO: 673 - DNA, 16 bp, Artificial Sequence
  Description of Artificial Sequence: antisense oligonucleotide
ttaataaaatagtcaa

SEQ ID NO: 674 - DNA, 17 bp, Artificial Sequence
  Description of Artificial Sequence: antisense oligonucleotide
tttaataaaatagtcaa

SEQ ID NO: 675 - DNA, 15 bp, Artificial Sequence
  Description of Artificial Sequence: antisense oligonucleotide
gtttaataaaatagt

SEQ ID NO: 676 - DNA, 16 bp, Artificial Sequence
  Description of Artificial Sequence: antisense oligonucleotide
agtttaataaaatagt

SEQ ID NO: 677 - DNA, 15 bp, Artificial Sequence
  Description of Artificial Sequence: antisense oligonucleotide
gagtttaataaaata

SEQ ID NO: 678 - DNA, 16 bp, Artificial Sequence
  Description of Artificial Sequence: antisense oligonucleotide
agagtttaataaaata

SEQ ID NO: 679 - DNA, 14 bp, Artificial Sequence
  Description of Artificial Sequence: antisense oligonucleotide
aataattcttgtat

SEQ ID NO: 680 - DNA, 14 bp, Artificial Sequence
  Description of Artificial Sequence: antisense oligonucleotide
tatattacattcat

SEQ ID NO: 681 - DNA, 14 bp, Artificial Sequence
  Description of Artificial Sequence: antisense oligonucleotide
atctatattacatt

SEQ ID NO: 682 - DNA, 14 bp, Artificial Sequence
  Description of Artificial Sequence: antisense oligonucleotide
ataaacatttttca

SEQ ID NO: 683 - DNA, 15 bp, Artificial Sequence
  Description of Artificial Sequence: antisense oligonucleotide
aataaacatttttca

SEQ ID NO: 684 - DNA, 16 bp, Artificial Sequence
  Description of Artificial Sequence: antisense oligonucleotide
aaataaacatttttca

SEQ ID NO: 685 - DNA, 15 bp, Artificial Sequence
  Description of Artificial Sequence: antisense oligonucleotide
gaaataaacattttt

SEQ ID NO: 686 - DNA, 16 bp, Artificial Sequence
  Description of Artificial Sequence: antisense oligonucleotide
tgaaataaacattttt

SEQ ID NO: 687 - DNA, 17 bp, Artificial Sequence
  Description of Artificial Sequence: antisense oligonucleotide
ttgaaataaacattttt

SEQ ID NO: 688 - DNA, 18 bp, Artificial Sequence
  Description of Artificial Sequence: antisense oligonucleotide
tttgaaataaacattttt

SEQ ID NO: 689 - DNA, 19 bp, Artificial Sequence
  Description of Artificial Sequence: antisense oligonucleotide
ttttgaaataaacattttt

SEQ ID NO: 690 - DNA, 20 bp, Artificial Sequence
  Description of Artificial Sequence: antisense oligonucleotide
tttttgaaataaacattttt

SEQ ID NO: 691 - DNA, 20 bp, Artificial Sequence
  Description of Artificial Sequence: antisense oligonucleotide
atttttgaaataaacatttt

SEQ ID NO: 692 - DNA, 19 bp, Artificial Sequence
  Description of Artificial Sequence: antisense oligonucleotide
aatttttgaaataaacatt

SEQ ID NO: 693 - DNA, 20 bp, Artificial Sequence
  Description of Artificial Sequence: antisense oligonucleotide
aaatttttgaaataaacatt

SEQ ID NO: 694 - DNA, 20 bp, Artificial Sequence
  Description of Artificial Sequence: antisense oligonucleotide
aaaatttttgaaataaacat

SEQ ID NO: 695 - DNA, 20 bp, Artificial Sequence
  Description of Artificial Sequence: antisense oligonucleotide
taaaatttttgaaataaaca

SEQ ID NO: 696 - DNA, 20 bp, Artificial Sequence
  Description of Artificial Sequence: antisense oligonucleotide
ataaaatttttgaaataaac

SEQ ID NO: 697 - DNA, 20 bp, Artificial Sequence
  Description of Artificial Sequence: antisense oligonucleotide
tataaaatttttgaaataaa

SEQ ID NO: 698 - DNA, 18 bp, Artificial Sequence
  Description of Artificial Sequence: antisense oligonucleotide
gtataaaatttttgaaat

SEQ ID NO: 699 - DNA, 14 bp, Artificial Sequence
  Description of Artificial Sequence: antisense oligonucleotide
ggtataaaattttt

SEQ ID NO: 700 - DNA, 15 bp, Artificial Sequence
  Description of Artificial Sequence: antisense oligonucleotide
aggtataaaattttt

SEQ ID NO: 701 - DNA, 16 bp, Artificial Sequence
  Description of Artificial Sequence: antisense oligonucleotide
aaggtataaaattttt

SEQ ID NO: 702 - DNA, 17 bp, Artificial Sequence
  Description of Artificial Sequence: antisense oligonucleotide
aaaggtataaaattttt

SEQ ID NO: 703 - DNA, 18 bp, Artificial Sequence
  Description of Artificial Sequence: antisense oligonucleotide
aaaaggtataaaattttt

SEQ ID NO: 704 - DNA, 19 bp, Artificial Sequence
  Description of Artificial Sequence: antisense oligonucleotide
taaaaggtataaaattttt

SEQ ID NO: 705 - DNA, 20 bp, Artificial Sequence
  Description of Artificial Sequence: antisense oligonucleotide
ataaaaggtataaaattttt

SEQ ID NO: 706 - DNA, 14 bp, Artificial Sequence
  Description of Artificial Sequence: antisense oligonucleotide
tttagaaagatttt

SEQ ID NO: 707 - DNA, 14 bp, Artificial Sequence
  Description of Artificial Sequence: antisense oligonucleotide
aagataaatttctt

SEQ ID NO: 708 - DNA, 15 bp, Artificial Sequence
  Description of Artificial Sequence: antisense oligonucleotide
taagataaatttctt

SEQ ID NO: 709 - DNA, 16 bp, Artificial Sequence
  Description of Artificial Sequence: antisense oligonucleotide
ttaagataaatttctt

SEQ ID NO: 710 - DNA, 17 bp, Artificial Sequence
  Description of Artificial Sequence: antisense oligonucleotide
tttaagataaatttctt

SEQ ID NO: 711 - DNA, 18 bp, Artificial Sequence
  Description of Artificial Sequence: antisense oligonucleotide
ttttaagataaatttctt

SEQ ID NO: 712 - DNA, 19 bp, Artificial Sequence
  Description of Artificial Sequence: antisense oligonucleotide
tttttaagataaatttctt

SEQ ID NO: 713 - DNA, 20 bp, Artificial Sequence
  Description of Artificial Sequence: antisense oligonucleotide
atttttaagataaatttctt

SEQ ID NO: 714 - DNA, 20 bp, Artificial Sequence
  Description of Artificial Sequence: antisense oligonucleotide
tatttttaagataaatttct

SEQ ID NO: 715 - DNA, 18 bp, Artificial Sequence
  Description of Artificial Sequence: antisense oligonucleotide
ttatttttaagataaatt

SEQ ID NO: 716 - DNA, 19 bp, Artificial Sequence
  Description of Artificial Sequence: antisense oligonucleotide
tttatttttaagataaatt

SEQ ID NO: 717 - DNA, 19 bp, Artificial Sequence
  Description of Artificial Sequence: antisense oligonucleotide
ctttatttttaagataaat

SEQ ID NO: 718 - DNA, 20 bp, Artificial Sequence
  Description of Artificial Sequence: antisense oligonucleotide
tctttatttttaagataaat

SEQ ID NO: 719 - DNA, 20 bp, Artificial Sequence
  Description of Artificial Sequence: antisense oligonucleotide
atctttatttttaagataaa

SEQ ID NO: 720 - DNA, 14 bp, Artificial Sequence
  Description of Artificial Sequence: antisense oligonucleotide
atctttatttttaa

SEQ ID NO: 721 - DNA, 15 bp, Artificial Sequence
  Description of Artificial Sequence: antisense oligonucleotide
gatctttatttttaa

SEQ ID NO: 722 - DNA, 16 bp, Artificial Sequence
  Description of Artificial Sequence: antisense oligonucleotide
agatctttatttttaa

SEQ ID NO: 723 - DNA, 17 bp, Artificial Sequence
  Description of Artificial Sequence: antisense oligonucleotide
tagatctttatttttaa

SEQ ID NO: 724 - DNA, 14 bp, Artificial Sequence
  Description of Artificial Sequence: antisense oligonucleotide
aatcatcattaatt

SEQ ID NO: 725 - DNA, 15 bp, Artificial Sequence
  Description of Artificial Sequence: antisense oligonucleotide
aaatcatcattaatt

SEQ ID NO: 726 - DNA, 16 bp, Artificial Sequence
  Description of Artificial Sequence: antisense oligonucleotide
aaaatcatcattaatt

SEQ ID NO: 727 - DNA, 17 bp, Artificial Sequence
  Description of Artificial Sequence: antisense oligonucleotide
taaaatcatcattaatt

SEQ ID NO: 728 - DNA, 18 bp, Artificial Sequence
  Description of Artificial Sequence: antisense oligonucleotide
ttaaaatcatcattaatt

SEQ ID NO: 729 - DNA, 19 bp, Artificial Sequence
  Description of Artificial Sequence: antisense oligonucleotide
tttaaaatcatcattaatt

SEQ ID NO: 730 - DNA, 20 bp, Artificial Sequence
  Description of Artificial Sequence: antisense oligonucleotide
atttaaaatcatcattaatt

SEQ ID NO: 731 - DNA, 19 bp, Artificial Sequence
  Description of Artificial Sequence: antisense oligonucleotide
aatttaaaatcatcattaa

SEQ ID NO: 732 - DNA, 14 bp, Artificial Sequence
  Description of Artificial Sequence: antisense oligonucleotide
gaatttaaaatcat

SEQ ID NO: 733 - DNA, 15 bp, Artificial Sequence
  Description of Artificial Sequence: antisense oligonucleotide
tgaatttaaaatcat

SEQ ID NO: 734 - DNA, 14 bp, Artificial Sequence
  Description of Artificial Sequence: antisense oligonucleotide
ttaaaataggaaat

SEQ ID NO: 735 - DNA, 14 bp, Artificial Sequence
  Description of Artificial Sequence: antisense oligonucleotide
aatttctctttaaa

SEQ ID NO: 736 - DNA, 15 bp, Artificial Sequence
  Description of Artificial Sequence: antisense oligonucleotide
aaatttctctttaaa

SEQ ID NO: 737 - DNA, 14 bp, Artificial Sequence
  Description of Artificial Sequence: antisense oligonucleotide
taaaattttgaatg

SEQ ID NO: 738 - DNA, 14 bp, Artificial Sequence
  Description of Artificial Sequence: antisense oligonucleotide
ctaaaattttgaat

SEQ ID NO: 739 - DNA, 14 bp, Artificial Sequence
  Description of Artificial Sequence: antisense oligonucleotide
tttgctaaaatttt

SEQ ID NO: 740 - DNA, 14 bp, Artificial Sequence
  Description of Artificial Sequence: antisense oligonucleotide
atatgaaaaatgtt

SEQ ID NO: 741 - DNA, 14 bp, Artificial Sequence
  Description of Artificial Sequence: antisense oligonucleotide
ttttaaattaagca

SEQ ID NO: 742 - DNA, 14 bp, Artificial Sequence
  Description of Artificial Sequence: antisense oligonucleotide
ttgtaaaaatcaaa

SEQ ID NO: 743 - DNA, 15 bp, Artificial Sequence
  Description of Artificial Sequence: antisense oligonucleotide
tttgtaaaaatcaaa

SEQ ID NO: 744 - DNA, 14 bp, Artificial Sequence
  Description of Artificial Sequence: antisense oligonucleotide
tttgataaaacttt

SEQ ID NO: 745 - DNA, 14 bp, Artificial Sequence
  Description of Artificial Sequence: antisense oligonucleotide
atgttttatcattt

SEQ ID NO: 746 - DNA, 15 bp, Artificial Sequence
  Description of Artificial Sequence: antisense oligonucleotide
aatgttttatcattt

SEQ ID NO: 747 - DNA, 16 bp, Artificial Sequence
  Description of Artificial Sequence: antisense oligonucleotide
aaatgttttatcattt

SEQ ID NO: 748 - DNA, 17 bp, Artificial Sequence
  Description of Artificial Sequence: antisense oligonucleotide
taaatgttttatcattt

SEQ ID NO: 749 - DNA, 14 bp, Artificial Sequence
  Description of Artificial Sequence: antisense oligonucleotide
tctaaatgttttat

SEQ ID NO: 750 - DNA, 15 bp, Artificial Sequence
  Description of Artificial Sequence: antisense oligonucleotide
ttctaaatgttttat

SEQ ID NO: 751 - DNA, 14 bp, Artificial Sequence
  Description of Artificial Sequence: antisense oligonucleotide
taagatcaaataaa

SEQ ID NO: 752 - DNA, 15 bp, Artificial Sequence
  Description of Artificial Sequence: antisense oligonucleotide
ataagatcaaataaa

SEQ ID NO: 753 - DNA, 16 bp, Artificial Sequence
  Description of Artificial Sequence: antisense oligonucleotide
aataagatcaaataaa

SEQ ID NO: 754 - DNA, 17 bp, Artificial Sequence
  Description of Artificial Sequence: antisense oligonucleotide
taataagatcaaataaa

SEQ ID NO: 755 - DNA, 18 bp, Artificial Sequence
  Description of Artificial Sequence: antisense oligonucleotide
ttaataagatcaaataaa

SEQ ID NO: 756 - DNA, 19 bp, Artificial Sequence
  Description of Artificial Sequence: antisense oligonucleotide
tttaataagatcaaataaa

SEQ ID NO: 757 - DNA, 14 bp, Artificial Sequence
  Description of Artificial Sequence: antisense oligonucleotide
ttgtttaataagat

SEQ ID NO: 758 - DNA, 15 bp, Artificial Sequence
  Description of Artificial Sequence: antisense oligonucleotide
attgtttaataagat

SEQ ID NO: 759 - DNA, 14 bp, Artificial Sequence
  Description of Artificial Sequence: antisense oligonucleotide
tgattgtttaataa

SEQ ID NO: 760 - DNA, 15 bp, Artificial Sequence
  Description of Artificial Sequence: antisense oligonucleotide
ttgattgtttaataa

SEQ ID NO: 761 - DNA, 16 bp, Artificial Sequence
  Description of Artificial Sequence: antisense oligonucleotide
tttgattgtttaataa

SEQ ID NO: 762 - DNA, 14 bp, Artificial Sequence
  Description of Artificial Sequence: antisense oligonucleotide
ttttataaaacagt

SEQ ID NO: 763 - DNA, 15 bp, Artificial Sequence
  Description of Artificial Sequence: antisense oligonucleotide
tttttataaaacagt

SEQ ID NO: 764 - DNA, 16 bp, Artificial Sequence
  Description of Artificial Sequence: antisense oligonucleotide
ttttttataaaacagt

SEQ ID NO: 765 - DNA, 15 bp, Artificial Sequence
  Description of Artificial Sequence: antisense oligonucleotide
cttttttataaaaca

SEQ ID NO: 766 - DNA, 16 bp, Artificial Sequence
  Description of Artificial Sequence: antisense oligonucleotide
acttttttataaaaca

SEQ ID NO: 767 - DNA, 15 bp, Artificial Sequence
  Description of Artificial Sequence: antisense oligonucleotide
cacttttttataaaa

SEQ ID NO: 768 - DNA, 16 bp, Artificial Sequence
  Description of Artificial Sequence: antisense oligonucleotide
acacttttttataaaa

SEQ ID NO: 769 - DNA, 17 bp, Artificial Sequence
  Description of Artificial Sequence: antisense oligonucleotide
tacacttttttataaaa

SEQ ID NO: 770 - DNA, 18 bp, Artificial Sequence
  Description of Artificial Sequence: antisense oligonucleotide
atacacttttttataaaa

SEQ ID NO: 771 - DNA, 14 bp, Artificial Sequence
  Description of Artificial Sequence: antisense oligonucleotide
attttgaatttaag

SEQ ID NO: 772 - DNA, 14 bp, Artificial Sequence
  Description of Artificial Sequence: antisense oligonucleotide
gattttgaatttaa

SEQ ID NO: 773 - DNA, 15 bp, Artificial Sequence
  Description of Artificial Sequence: antisense oligonucleotide
tgattttgaatttaa

SEQ ID NO: 774 - DNA, 16 bp, Artificial Sequence
  Description of Artificial Sequence: antisense oligonucleotide
atgattttgaatttaa

SEQ ID NO: 775 - DNA, 17 bp, Artificial Sequence
  Description of Artificial Sequence: antisense oligonucleotide
aatgattttgaatttaa

SEQ ID NO: 776 - DNA, 14 bp, Artificial Sequence
  Description of Artificial Sequence: antisense oligonucleotide
ataatagaatcata

SEQ ID NO: 777 - DNA, 15 bp, Artificial Sequence
  Description of Artificial Sequence: antisense oligonucleotide
tataatagaatcata

SEQ ID NO: 778 - DNA, 14 bp, Artificial Sequence
  Description of Artificial Sequence: antisense oligonucleotide
tataatagaatcat

SEQ ID NO: 779 - DNA, 14 bp, Artificial Sequence
  Description of Artificial Sequence: antisense oligonucleotide
tactataatagaat

SEQ ID NO: 780 - DNA, 15 bp, Artificial Sequence
  Description of Artificial Sequence: antisense oligonucleotide
atactataatagaat

SEQ ID NO: 781 - DNA, 16 bp, Artificial Sequence
  Description of Artificial Sequence: antisense oligonucleotide
aatactataatagaat

SEQ ID NO: 782 - DNA, 14 bp, Artificial Sequence
  Description of Artificial Sequence: antisense oligonucleotide
agaatactataata

SEQ ID NO: 783 - DNA, 15 bp, Artificial Sequence
  Description of Artificial Sequence: antisense oligonucleotide
tagaatactataata

SEQ ID NO: 784 - DNA, 16 bp, Artificial Sequence
  Description of Artificial Sequence: antisense oligonucleotide
atagaatactataata

SEQ ID NO: 785 - DNA, 17 bp, Artificial Sequence
  Description of Artificial Sequence: antisense oligonucleotide
tatagaatactataata

SEQ ID NO: 786 - DNA, 18 bp, Artificial Sequence
  Description of Artificial Sequence: antisense oligonucleotide
ttatagaatactataata

SEQ ID NO: 787 - DNA, 14 bp, Artificial Sequence
  Description of Artificial Sequence: antisense oligonucleotide
aatatttgttttca

SEQ ID NO: 788 - DNA, 15 bp, Artificial Sequence
  Description of Artificial Sequence: antisense oligonucleotide
aaatatttgttttca

SEQ ID NO: 789 - DNA, 16 bp, Artificial Sequence
  Description of Artificial Sequence: antisense oligonucleotide
aaaatatttgttttca

SEQ ID NO: 790 - DNA, 15 bp, Artificial Sequence
  Description of Artificial Sequence: antisense oligonucleotide
caaaatatttgtttt

SEQ ID NO: 791 - DNA, 14 bp, Artificial Sequence
  Description of Artificial Sequence: antisense oligonucleotide
aaattttatatgga

SEQ ID NO: 792 - DNA, 14 bp, Artificial Sequence
  Description of Artificial Sequence: antisense oligonucleotide
tgaaattttatatg

SEQ ID NO: 793 - DNA, 14 bp, Artificial Sequence
  Description of Artificial Sequence: antisense oligonucleotide
ctgaaattttatat

SEQ ID NO: 794 - DNA, 15 bp, Artificial Sequence
  Description of Artificial Sequence: antisense oligonucleotide
tctgaaattttatat

SEQ ID NO: 795 - DNA, 16 bp, Artificial Sequence
  Description of Artificial Sequence: antisense oligonucleotide
ttctgaaattttatat

SEQ ID NO: 796 - DNA, 14 bp, Artificial Sequence
  Description of Artificial Sequence: antisense oligonucleotide
atctgatttatttt

SEQ ID NO: 797 - DNA, 14 bp, Artificial Sequence
  Description of Artificial Sequence: antisense oligonucleotide
aagatattaaatgt

SEQ ID NO: 798 - DNA, 14 bp, Artificial Sequence
  Description of Artificial Sequence: antisense oligonucleotide
tgaagatattaaat

SEQ ID NO: 799 - DNA, 14 bp, Artificial Sequence
  Description of Artificial Sequence: antisense oligonucleotide
ataaataacaatga

SEQ ID NO: 800 - DNA, 15 bp, Artificial Sequence
  Description of Artificial Sequence: antisense oligonucleotide
tataaataacaatga

SEQ ID NO: 801 - DNA, 14 bp, Artificial Sequence
  Description of Artificial Sequence: antisense oligonucleotide
gtataaataacaat

SEQ ID NO: 802 - DNA, 15 bp, Artificial Sequence
  Description of Artificial Sequence: antisense oligonucleotide
tgtataaataacaat

SEQ ID NO: 803 - DNA, 16 bp, Artificial Sequence
  Description of Artificial Sequence: antisense oligonucleotide
ttgtataaataacaat

SEQ ID NO: 804 - DNA, 14 bp, Artificial Sequence
  Description of Artificial Sequence: antisense oligonucleotide
tcttgtataaataa

SEQ ID NO: 805 - DNA, 15 bp, Artificial Sequence
  Description of Artificial Sequence: antisense oligonucleotide
atcttgtataaataa

SEQ ID NO: 806 - DNA, 16 bp, Artificial Sequence
  Description of Artificial Sequence: antisense oligonucleotide
aatcttgtataaataa

SEQ ID NO: 807 - DNA, 14 bp, Artificial Sequence
  Description of Artificial Sequence: antisense oligonucleotide
acaactttttaaat

SEQ ID NO: 808 - DNA, 15 bp, Artificial Sequence
  Description of Artificial Sequence: antisense oligonucleotide
tacaactttttaaat

SEQ ID NO: 809 - DNA, 14 bp, Artificial Sequence
  Description of Artificial Sequence: antisense oligonucleotide
tacaactttttaaa

SEQ ID NO: 810 - DNA, 21 bp, Artificial Sequence
  Description of Artificial Sequence: antisense oligonucleotide
cggggggttttgggcggcatg

SEQ ID NO: 811 - DNA, 23 bp, Artificial Sequence
  Description of Artificial Sequence: antisense oligonucleotide
ttttcggggggttttgggcggca

SEQ ID NO: 812 - DNA, 19 bp, Artificial Sequence
  Description of Artificial Sequence: antisense oligonucleotide
tcggggggttttgggcggc

SEQ ID NO: 813 - DNA, 24 bp, Artificial Sequence
  Description of Artificial Sequence: antisense oligonucleotide
ggtggcggccgtttttcggggggt

SEQ ID NO: 814 - DNA, 23 bp, Artificial Sequence
  Description of Artificial Sequence: antisense oligonucleotide
ccgggggttccgcggcggcagcg

SEQ ID NO: 815 - DNA, 17 bp, Artificial Sequence
  Description of Artificial Sequence: antisense oligonucleotide
cgggggttccgcggcgg

SEQ ID NO: 816 - DNA, 23 bp, Artificial Sequence
  Description of Artificial Sequence: antisense oligonucleotide
ggcggcggtgccgggggttccgc

SEQ ID NO: 817 - DNA, 22 bp, Artificial Sequence
  Description of Artificial Sequence: antisense oligonucleotide
ggagggggcggcggcggcggtg

SEQ ID NO: 818 - DNA, 17 bp, Artificial Sequence
  Description of Artificial Sequence: antisense oligonucleotide
gggggcggcggcggcgg

SEQ ID NO: 819 - DNA, 15 bp, Artificial Sequence
  Description of Artificial Sequence: antisense oligonucleotide
ggggcggcggcggcg

SEQ ID NO: 820 - DNA, 17 bp, Artificial Sequence
  Description of Artificial Sequence: antisense oligonucleotide
agggggcctggtggaag

SEQ ID NO: 821 - DNA, 14 bp, Artificial Sequence
  Description of Artificial Sequence: antisense oligonucleotide
tagggggcctggtg

SEQ ID NO: 822 - DNA, 14 bp, Artificial Sequence
  Description of Artificial Sequence: antisense oligonucleotide
gtagggggcctggt

SEQ ID NO: 823 - DNA, 26 bp, Artificial Sequence
  Description of Artificial Sequence: antisense oligonucleotide
gaggtattggtgacaaggtagggggc

SEQ ID NO: 824 - DNA, 26 bp, Artificial Sequence
  Description of Artificial Sequence: antisense oligonucleotide
tcttcaggggtgaaatatagatgttc

SEQ ID NO: 825 - DNA, 16 bp, Artificial Sequence
  Description of Artificial Sequence: antisense oligonucleotide
ggactcttcaggggtg

SEQ ID NO: 826 - DNA, 14 bp, Artificial Sequence
  Description of Artificial Sequence: antisense oligonucleotide
tcggactatactgc

SEQ ID NO: 827 - DNA, 16 bp, Artificial Sequence
  Description of Artificial Sequence: antisense oligonucleotide
cagttcggactatact

SEQ ID NO: 828 - DNA, 14 bp, Artificial Sequence
  Description of Artificial Sequence: antisense oligonucleotide
aagcctaagacgca

SEQ ID NO: 829 - DNA, 14 bp, Artificial Sequence
  Description of Artificial Sequence: antisense oligonucleotide
gcccaagttcaaca

SEQ ID NO: 830 - DNA, 14 bp, Artificial Sequence
  Description of Artificial Sequence: antisense oligonucleotide
tgaaaagtcgcggt

SEQ ID NO: 831 - DNA, 18 bp, Artificial Sequence
  Description of Artificial Sequence: antisense oligonucleotide
ggttaattaagatgcctc

SEQ ID NO: 832 - DNA, 14 bp, Artificial Sequence
  Description of Artificial Sequence: antisense oligonucleotide
tctctaagagcgca

SEQ ID NO: 833 - DNA, 16 bp, Artificial Sequence
  Description of Artificial Sequence: antisense oligonucleotide
acgtgaggttagtttg

SEQ ID NO: 834 - DNA, 14 bp, Artificial Sequence
  Description of Artificial Sequence: antisense oligonucleotide
cacgtgaggttagt

SEQ ID NO: 835 - DNA, 14 bp, Artificial Sequence
  Description of Artificial Sequence: antisense oligonucleotide
catagaacagtccg

SEQ ID NO: 836 - DNA, 16 bp, Artificial Sequence
  Description of Artificial Sequence: antisense oligonucleotide
cagtcatagaacagtc

SEQ ID NO: 837 - DNA, 18 bp, Artificial Sequence
  Description of Artificial Sequence: antisense oligonucleotide
ctttgcagtcatagaaca

SEQ ID NO: 838 - DNA, 14 bp, Artificial Sequence
  Description of Artificial Sequence: antisense oligonucleotide
tgcagtcatagaac

SEQ ID NO: 839 - DNA, 14 bp, Artificial Sequence
  Description of Artificial Sequence: antisense oligonucleotide
ggtcgtttccatct

SEQ ID NO: 840 - DNA, 16 bp, Artificial Sequence
  Description of Artificial Sequence: antisense oligonucleotide
catagaaggtcgtttc

SEQ ID NO: 841 - DNA, 14 bp, Artificial Sequence
  Description of Artificial Sequence: antisense oligonucleotide
cgtcatagaaggtc

SEQ ID NO: 842 - DNA, 15 bp, Artificial Sequence
  Description of Artificial Sequence: antisense oligonucleotide
catcgtcatagaagg

SEQ ID NO: 843 - DNA, 24 bp, Artificial Sequence
  Description of Artificial Sequence: antisense oligonucleotide
ggacgggaggaacgaggcgttgag

SEQ ID NO: 844 - DNA, 14 bp, Artificial Sequence
  Description of Artificial Sequence: antisense oligonucleotide
tagccataaggtcc

SEQ ID NO: 845 - DNA, 14 bp, Artificial Sequence
  Description of Artificial Sequence: antisense oligonucleotide
ggttactgtagcca

SEQ ID NO: 846 - DNA, 14 bp, Artificial Sequence
  Description of Artificial Sequence: antisense oligonucleotide
ggttactgtagcca

SEQ ID NO: 847 - DNA, 18 bp, Artificial Sequence
  Description of Artificial Sequence: antisense oligonucleotide
agttcttggcgcggaggt

SEQ ID NO: 848 - DNA, 18 bp, Artificial Sequence
  Description of Artificial Sequence: antisense oligonucleotide
aggtgaggaggtccgagt

SEQ ID NO: 849 - DNA, 16 bp, Artificial Sequence
  Description of Artificial Sequence: antisense oligonucleotide
tggactggattatcag

SEQ ID NO: 850 - DNA, 18 bp, Artificial Sequence
  Description of Artificial Sequence: antisense oligonucleotide
gtggtggtgatgtgcccg

SEQ ID NO: 851 - DNA, 14 bp, Artificial Sequence
  Description of Artificial Sequence: antisense oligonucleotide
tgtcacgttcttgg

SEQ ID NO: 852 - DNA, 14 bp, Artificial Sequence
  Description of Artificial Sequence: antisense oligonucleotide
ctcatctgtcacgt

SEQ ID NO: 853 - DNA, 18 bp, Artificial Sequence
  Description of Artificial Sequence: antisense oligonucleotide
cgaagccctcggcgaacc

SEQ ID NO: 854 - DNA, 24 bp, Artificial Sequence
  Description of Artificial Sequence: antisense oligonucleotide
gcgtgttctggctgtgcagttcgg

SEQ ID NO: 855 - DNA, 14 bp, Artificial Sequence
  Description of Artificial Sequence: antisense oligonucleotide
ctgccccgttgacc

SEQ ID NO: 856 - DNA, 14 bp, Artificial Sequence
  Description of Artificial Sequence: antisense oligonucleotide
aggtttgcgtagac

SEQ ID NO: 857 - DNA, 14 bp, Artificial Sequence
  Description of Artificial Sequence: antisense oligonucleotide
ggttgaagttgctg

SEQ ID NO: 858 - DNA, 14 bp, Artificial Sequence
  Description of Artificial Sequence: antisense oligonucleotide
ctgggttgaagttg

SEQ ID NO: 859 - DNA, 20 bp, Artificial Sequence
  Description of Artificial Sequence: antisense oligonucleotide
tgctgcacgggcatctgctg

SEQ ID NO: 860 - DNA, 27 bp, Artificial Sequence
  Description of Artificial Sequence: antisense oligonucleotide
ggcactgtctgaggctcctccttcagg

SEQ ID NO: 861 - DNA, 14 bp, Artificial Sequence
  Description of Artificial Sequence: antisense oligonucleotide
actccatgtcgatg

SEQ ID NO: 862 - DNA, 16 bp, Artificial Sequence
  Description of Artificial Sequence: antisense oligonucleotide
ctctccgccttgatcc

SEQ ID NO: 863 - DNA, 16 bp, Artificial Sequence
  Description of Artificial Sequence: antisense oligonucleotide
gttcctcatgcgcttc

SEQ ID NO: 864 - DNA, 14 bp, Artificial Sequence
  Description of Artificial Sequence: antisense oligonucleotide
ctgagctttcaagg

SEQ ID NO: 865 - DNA, 26 bp, Artificial Sequence
  Description of Artificial Sequence: antisense oligonucleotide
gcgattctctccagcttcctttttcg

SEQ ID NO: 866 - DNA, 30 bp, Artificial Sequence
  Description of Artificial Sequence: antisense oligonucleotide
ctgagctttcaaggttttcactttttcctc

SEQ ID NO: 867 - DNA, 14 bp, Artificial Sequence
  Description of Artificial Sequence: antisense oligonucleotide
tccctgagcatgtt

SEQ ID NO: 868 - DNA, 16 bp, Artificial Sequence
  Description of Artificial Sequence: antisense oligonucleotide
tctgtttaagctgtgc

SEQ ID NO: 869 - DNA, 18 bp, Artificial Sequence
  Description of Artificial Sequence: antisense oligonucleotide
ctttctgtttaagctgtg

SEQ ID NO: 870 - DNA, 16 bp, Artificial Sequence
  Description of Artificial Sequence: antisense oligonucleotide
ggttcatgactttctg

SEQ ID NO: 871 - DNA, 14 bp, Artificial Sequence
  Description of Artificial Sequence: antisense oligonucleotide
cgtggttcatgact

SEQ ID NO: 872 - DNA, 16 bp, Artificial Sequence
  Description of Artificial Sequence: antisense oligonucleotide
actgttaacgtggttc

SEQ ID NO: 873 - DNA, 14 bp, Artificial Sequence
  Description of Artificial Sequence: antisense oligonucleotide
ccactgttaacgtg

SEQ ID NO: 874 - DNA, 14 bp, Artificial Sequence
  Description of Artificial Sequence: antisense oligonucleotide
cccactgttaacgt

SEQ ID NO: 875 - DNA, 14 bp, Artificial Sequence
  Description of Artificial Sequence: antisense oligonucleotide
agcatgagttggca

SEQ ID NO: 876 - DNA, 14 bp, Artificial Sequence
  Description of Artificial Sequence: antisense oligonucleotide
gcgttagcatgagt

SEQ ID NO: 877 - DNA, 14 bp, Artificial Sequence
  Description of Artificial Sequence: antisense oligonucleotide
gtttgcaactgctg

SEQ ID NO: 878 - DNA, 18 bp, Artificial Sequence
  Description of Artificial Sequence: antisense oligonucleotide
caaaatgtttgcaactgc

SEQ ID NO: 879 - DNA, 18 bp, Artificial Sequence
  Description of Artificial Sequence: antisense oligonucleotide
tccattttagtgcacatc

SEQ ID NO: 880 - DNA, 18 bp, Artificial Sequence
  Description of Artificial Sequence: antisense oligonucleotide
ctgttccattttagtgca

SEQ ID NO: 881 - DNA, 14 bp, Artificial Sequence
  Description of Artificial Sequence: antisense oligonucleotide
gtgtatgagtcgtc

SEQ ID NO: 882 - DNA, 14 bp, Artificial Sequence
  Description of Artificial Sequence: antisense oligonucleotide
ctgtgtatgagtcg

SEQ ID NO: 883 - DNA, 14 bp, Artificial Sequence
  Description of Artificial Sequence: antisense oligonucleotide
cgtagctgtgtatg

SEQ ID NO: 884 - DNA, 14 bp, Artificial Sequence
  Description of Artificial Sequence: antisense oligonucleotide
tcgtgtagagagag

SEQ ID NO: 885 - DNA, 18 bp, Artificial Sequence
  Description of Artificial Sequence: antisense oligonucleotide
agtttgtagtcgtgtaga

SEQ ID NO: 886 - DNA, 16 bp, Artificial Sequence
  Description of Artificial Sequence: antisense oligonucleotide
gtttgtagtcgtgtag

SEQ ID NO: 887 - DNA, 14 bp, Artificial Sequence
  Description of Artificial Sequence: antisense oligonucleotide
agtttgtagtcgtg

SEQ ID NO: 888 - DNA, 14 bp, Artificial Sequence
  Description of Artificial Sequence: antisense oligonucleotide
ggagtttgtagtcg

SEQ ID NO: 889 - DNA, 16 bp, Artificial Sequence
  Description of Artificial Sequence: antisense oligonucleotide
tcaggagtttgtagtc

SEQ ID NO: 890 - DNA, 18 bp, Artificial Sequence
  Description of Artificial Sequence: antisense oligonucleotide
gtttcaggagtttgtagt

SEQ ID NO: 891 - DNA, 14 bp, Artificial Sequence
  Description of Artificial Sequence: antisense oligonucleotide
tcggtttcaggagt

SEQ ID NO: 892 - DNA, 14 bp, Artificial Sequence
  Description of Artificial Sequence: antisense oligonucleotide
ttgagactccggta

SEQ ID NO: 893 - DNA, 16 bp, Artificial Sequence
  Description of Artificial Sequence: antisense oligonucleotide
accagaaaagtagctg

SEQ ID NO: 894 - DNA, 14 bp, Artificial Sequence
  Description of Artificial Sequence: antisense oligonucleotide
cctgaccagaaaag

SEQ ID NO: 895 - DNA, 14 bp, Artificial Sequence
  Description of Artificial Sequence: antisense oligonucleotide
attcaggcgttcca

SEQ ID NO: 896 - DNA, 16 bp, Artificial Sequence
  Description of Artificial Sequence: antisense oligonucleotide
ggtaaaagtactgtcc

SEQ ID NO: 897 - DNA, 16 bp, Artificial Sequence
  Description of Artificial Sequence: antisense oligonucleotide
gggtaaaagtactgtc

SEQ ID NO: 898 - DNA, 18 bp, Artificial Sequence
  Description of Artificial Sequence: antisense oligonucleotide
gcacctccaccgctgcca

SEQ ID NO: 899 - DNA, 18 bp, Artificial Sequence
  Description of Artificial Sequence: antisense oligonucleotide
ctcctgctcctcggtgac

SEQ ID NO: 900 - DNA, 14 bp, Artificial Sequence
  Description of Artificial Sequence: antisense oligonucleotide
gctttgacaaagcc

SEQ ID NO: 901 - DNA, 14 bp, Artificial Sequence
  Description of Artificial Sequence: antisense oligonucleotide
cttgtgcagatcgt

SEQ ID NO: 902 - DNA, 16 bp, Artificial Sequence
  Description of Artificial Sequence: antisense oligonucleotide
tcatcttgtgcagatc

SEQ ID NO: 903 - DNA, 16 bp, Artificial Sequence
  Description of Artificial Sequence: antisense oligonucleotide
gttcatcttgtgcaga

SEQ ID NO: 904 - DNA, 14 bp, Artificial Sequence
  Description of Artificial Sequence: antisense oligonucleotide
cgtggttcatcttg

SEQ ID NO: 905 - DNA, 14 bp, Artificial Sequence
  Description of Artificial Sequence: antisense oligonucleotide
tcacgtggttcatc

SEQ ID NO: 906 - DNA, 14 bp, Artificial Sequence
  Description of Artificial Sequence: antisense oligonucleotide
ggttggtgtaaacg

SEQ ID NO: 907 - DNA, 20 bp, Artificial Sequence
  Description of Artificial Sequence: antisense oligonucleotide
tacgagctcccggtcccgac

SEQ ID NO: 908 - DNA, 14 bp, Artificial Sequence
  Description of Artificial Sequence: antisense oligonucleotide
tagctgatggtggt

SEQ ID NO: 909 - DNA, 14 bp, Artificial Sequence
  Description of Artificial Sequence: antisense oligonucleotide
tccttgaaggtgga

SEQ ID NO: 910 - DNA, 16 bp, Artificial Sequence
  Description of Artificial Sequence: antisense oligonucleotide
tcttccatgttgatgg

SEQ ID NO: 911 - DNA, 14 bp, Artificial Sequence
  Description of Artificial Sequence: antisense oligonucleotide
ctttgatgcgctct

SEQ ID NO: 912 - DNA, 14 bp, Artificial Sequence
  Description of Artificial Sequence: antisense oligonucleotide
ctccactttgatgc

SEQ ID NO: 913 - DNA, 30 bp, Artificial Sequence
  Description of Artificial Sequence: antisense oligonucleotide
gctccagcttccgcttccggcacttggtgg

SEQ ID NO: 914 - DNA, 30 bp, Artificial Sequence
  Description of Artificial Sequence: antisense oligonucleotide
ggccttgagcgtcttcaccttgtcctccag

SEQ ID NO: 915 - DNA, 16 bp, Artificial Sequence
  Description of Artificial Sequence: antisense oligonucleotide
tgaccttctgtttgag

SEQ ID NO: 916 - DNA, 16 bp, Artificial Sequence
  Description of Artificial Sequence: antisense oligonucleotide
catgaccttctgtttg

SEQ ID NO: 917 - DNA, 14 bp, Artificial Sequence
  Description of Artificial Sequence: antisense oligonucleotide
gtcatgaccttctg

SEQ ID NO: 918 - DNA, 14 bp, Artificial Sequence
  Description of Artificial Sequence: antisense oligonucleotide
cgagaacatcatcg

SEQ ID NO: 919 - DNA, 14 bp, Artificial Sequence
  Description of Artificial Sequence: antisense oligonucleotide
gtagtctgcgttga

SEQ ID NO: 920 - DNA, 20 bp, Artificial Sequence
  Description of Artificial Sequence: antisense oligonucleotide
gctgcagcgggaggatgacg

SEQ ID NO: 921 - DNA, 16 bp, Artificial Sequence
  Description of Artificial Sequence: antisense oligonucleotide
agtaagagaggctatc

SEQ ID NO: 922 - DNA, 14 bp, Artificial Sequence
  Description of Artificial Sequence: antisense oligonucleotide
gtagtaagagaggc

SEQ ID NO: 923 - DNA, 14 bp, Artificial Sequence
  Description of Artificial Sequence: antisense oligonucleotide
ggtagtaagagagg

SEQ ID NO: 924 - DNA, 16 bp, Artificial Sequence
  Description of Artificial Sequence: antisense oligonucleotide
gtgagtggtagtaaga

SEQ ID NO: 925 - DNA, 18 bp, Artificial Sequence
  Description of Artificial Sequence: antisense oligonucleotide
gtccgtgcagaagtcctg

SEQ ID NO: 926 - DNA, 16 bp, Artificial Sequence
  Description of Artificial Sequence: antisense oligonucleotide
gaatgaagttggcact

SEQ ID NO: 927 - DNA, 14 bp, Artificial Sequence
  Description of Artificial Sequence: antisense oligonucleotide
ggaatgaagttggc

SEQ ID NO: 928 - DNA, 14 bp, Artificial Sequence
  Description of Artificial Sequence: antisense oligonucleotide
gggaatgaagttgg

SEQ ID NO: 929 - DNA, 30 bp, Artificial Sequence
  Description of Artificial Sequence: antisense oligonucleotide
gctgcaccagccactgcaggtccggactgg

SEQ ID NO: 930 - DNA, 16 bp, Artificial Sequence
  Description of Artificial Sequence: antisense oligonucleotide
tcatggtcttcacaac

SEQ ID NO: 931 - DNA, 30 bp, Artificial Sequence
  Description of Artificial Sequence: antisense oligonucleotide
caatgctctgcgctcggcctcctgtcatgg

SEQ ID NO: 932 - DNA, 14 bp, Artificial Sequence
  Description of Artificial Sequence: antisense oligonucleotide
ctagagttcctcac

SEQ ID NO: 933 - DNA, 14 bp, Artificial Sequence
  Description of Artificial Sequence: antisense oligonucleotide
gagtacgctagagt

SEQ ID NO: 934 - DNA, 14 bp, Artificial Sequence
  Description of Artificial Sequence: antisense oligonucleotide
gaagagtacgctag

SEQ ID NO: 935 - DNA, 28 bp, Artificial Sequence
  Description of Artificial Sequence: antisense oligonucleotide
ctgcttcccacccagcccccacattccc

SEQ ID NO: 936 - DNA, 20 bp, Artificial Sequence
  Description of Artificial Sequence: antisense oligonucleotide
ttcatcctctgtactgggct

SEQ ID NO: 937 - DNA, 14 bp, Artificial Sequence
  Description of Artificial Sequence: antisense oligonucleotide
gttacggatgtgca

SEQ ID NO: 938 - DNA, 14 bp, Artificial Sequence
  Description of Artificial Sequence: antisense oligonucleotide
cagttacggatgtg

SEQ ID NO: 939 - DNA, 14 bp, Artificial Sequence
  Description of Artificial Sequence: antisense oligonucleotide
ccagttacggatgt

SEQ ID NO: 940 - DNA, 14 bp, Artificial Sequence
  Description of Artificial Sequence: antisense oligonucleotide
agagtctgagttgg

SEQ ID NO: 941 - DNA, 14 bp, Artificial Sequence
  Description of Artificial Sequence: antisense oligonucleotide
gtgagactcagagt

SEQ ID NO: 942 - DNA, 14 bp, Artificial Sequence
  Description of Artificial Sequence: antisense oligonucleotide
tcttagggtgagac

SEQ ID NO: 943 - DNA, 16 bp, Artificial Sequence
  Description of Artificial Sequence: antisense oligonucleotide
gagagtacttcttagg

SEQ ID NO: 944 - DNA, 18 bp, Artificial Sequence
  Description of Artificial Sequence: antisense oligonucleotide
ggaagaaactatgagagt

SEQ ID NO: 945 - DNA, 17 bp, Artificial Sequence
  Description of Artificial Sequence: antisense oligonucleotide
cttagggaagaactatg

SEQ ID NO: 946 - DNA, 16 bp, Artificial Sequence
  Description of Artificial Sequence: antisense oligonucleotide
cggtaagaaacttagg

SEQ ID NO: 947 - DNA, 14 bp, Artificial Sequence
  Description of Artificial Sequence: antisense oligonucleotide
agcatgcggtaaga

SEQ ID NO: 948 - DNA, 14 bp, Artificial Sequence
  Description of Artificial Sequence: antisense oligonucleotide
gtctgaaagcatgc

SEQ ID NO: 949 - DNA, 16 bp, Artificial Sequence
  Description of Artificial Sequence: antisense oligonucleotide
agaacaaagaagagcc

SEQ ID NO: 950 - DNA, 18 bp, Artificial Sequence
  Description of Artificial Sequence: antisense oligonucleotide
caagagaacaaagaagag

SEQ ID NO: 951 - DNA, 16 bp, Artificial Sequence
  Description of Artificial Sequence: antisense oligonucleotide
cagcaagagaacaaag

SEQ ID NO: 952 - DNA, 14 bp, Artificial Sequence
  Description of Artificial Sequence: antisense oligonucleotide
tcctcagcaagaga

SEQ ID NO: 953 - DNA, 14 bp, Artificial Sequence
  Description of Artificial Sequence: antisense oligonucleotide
aggtgtgacttgca

SEQ ID NO: 954 - DNA, 16 bp, Artificial Sequence
  Description of Artificial Sequence: antisense oligonucleotide
gaataggtgtgacttg

SEQ ID NO: 955 - DNA, 16 bp, Artificial Sequence
  Description of Artificial Sequence: antisense oligonucleotide
cagaataggtgtgact

SEQ ID NO: 956 - DNA, 14 bp, Artificial Sequence
  Description of Artificial Sequence: antisense oligonucleotide
gcagaataggtgtg

SEQ ID NO: 957 - DNA, 16 bp, Artificial Sequence
  Description of Artificial Sequence: antisense oligonucleotide
cagttgcagaataggt

SEQ ID NO: 958 - DNA, 16 bp, Artificial Sequence
  Description of Artificial Sequence: antisense oligonucleotide
gaaaccatttctgacc

SEQ ID NO: 959 - DNA, 18 bp, Artificial Sequence
  Description of Artificial Sequence: antisense oligonucleotide
tgtgaaaccatttctgac

SEQ ID NO: 960 - DNA, 18 bp, Artificial Sequence
  Description of Artificial Sequence: antisense oligonucleotide
cactgtgaaaccatttct

SEQ ID NO: 961 - DNA, 14 bp, Artificial Sequence
  Description of Artificial Sequence: antisense oligonucleotide
ccactgtgaaacca

SEQ ID NO: 962 - DNA, 30 bp, Artificial Sequence
  Description of Artificial Sequence: antisense oligonucleotide
agaactggctcctgcagcttccctgcttcc

SEQ ID NO: 963 - DNA, 15 bp, Artificial Sequence
  Description of Artificial Sequence: antisense oligonucleotide
cacctccattcaccc

SEQ ID NO: 964 - DNA, 16 bp, Artificial Sequence
  Description of Artificial Sequence: antisense oligonucleotide
cagtaaaagtgtctgc

SEQ ID NO: 965 - DNA, 18 bp, Artificial Sequence
  Description of Artificial Sequence: antisense oligonucleotide
cgacattcagtaaaagtg

SEQ ID NO: 966 - DNA, 14 bp, Artificial Sequence
  Description of Artificial Sequence: antisense oligonucleotide
gaccgacattcagt

SEQ ID NO: 967 - DNA, 18 bp, Artificial Sequence
  Description of Artificial Sequence: antisense oligonucleotide
cttctggagataactaga

SEQ ID NO: 968 - DNA, 18 bp, Artificial Sequence
  Description of Artificial Sequence: antisense oligonucleotide
catcttattcctttccct

SEQ ID NO: 969 - DNA, 16 bp, Artificial Sequence
  Description of Artificial Sequence: antisense oligonucleotide
cagccatcttattcct

SEQ ID NO: 970 - DNA, 16 bp, Artificial Sequence
  Description of Artificial Sequence: antisense oligonucleotide
tgcagccatcttattc

SEQ ID NO: 971 - DNA, 15 bp, Artificial Sequence
  Description of Artificial Sequence: antisense oligonucleotide
gagtgtatcagtcag

SEQ ID NO: 972 - DNA, 14 bp, Artificial Sequence
  Description of Artificial Sequence: antisense oligonucleotide
ggagtgtatcagtc

SEQ ID NO: 973 - DNA, 16 bp, Artificial Sequence
  Description of Artificial Sequence: antisense oligonucleotide
cttggagtgtatcagt

SEQ ID NO: 974 - DNA, 14 bp, Artificial Sequence
  Description of Artificial Sequence: antisense oligonucleotide
acagagtacctacc

SEQ ID NO: 975 - DNA, 16 bp, Artificial Sequence
  Description of Artificial Sequence: antisense oligonucleotide
ccaactttcccttaag

SEQ ID NO: 976 - DNA, 16 bp, Artificial Sequence
  Description of Artificial Sequence: antisense oligonucleotide
ccttatgctcaatctc

SEQ ID NO: 977 - DNA, 14 bp, Artificial Sequence
  Description of Artificial Sequence: antisense oligonucleotide
gtcttactcaaggg

SEQ ID NO: 978 - DNA, 16 bp, Artificial Sequence
  Description of Artificial Sequence: antisense oligonucleotide
acagtcttactcaagg

SEQ ID NO: 979 - DNA, 18 bp, Artificial Sequence
  Description of Artificial Sequence: antisense oligonucleotide
cataagacacagtcttac

SEQ ID NO: 980 - DNA, 18 bp, Artificial Sequence
  Description of Artificial Sequence: antisense oligonucleotide
gaaagcataagacacagt

SEQ ID NO: 981 - DNA, 16 bp, Artificial Sequence
  Description of Artificial Sequence: antisense oligonucleotide
ggaaagcataagacac

SEQ ID NO: 982 - DNA, 16 bp, Artificial Sequence
  Description of Artificial Sequence: antisense oligonucleotide
agggataaaggaaagc

SEQ ID NO: 983 - DNA, 14 bp, Artificial Sequence
  Description of Artificial Sequence: antisense oligonucleotide
cctgtatacagagg

SEQ ID NO: 984 - DNA, 16 bp, Artificial Sequence
  Description of Artificial Sequence: antisense oligonucleotide
tgtctcctgtatacag

SEQ ID NO: 985 - DNA, 16 bp, Artificial Sequence
  Description of Artificial Sequence: antisense oligonucleotide
catcttctagttggtc

SEQ ID NO: 986 - DNA, 16 bp, Artificial Sequence
  Description of Artificial Sequence: antisense oligonucleotide
ctcatcttctagttgg

SEQ ID NO: 987 - DNA, 18 bp, Artificial Sequence
  Description of Artificial Sequence: antisense oligonucleotide
cttctcatcttctagttg

SEQ ID NO: 988 - DNA, 16 bp, Artificial Sequence
  Description of Artificial Sequence: antisense oligonucleotide
caaagcagacttctca

SEQ ID NO: 989 - DNA, 14 bp, Artificial Sequence
  Description of Artificial Sequence: antisense oligonucleotide
ctgcaaagcagact

SEQ ID NO: 990 - DNA, 18 bp, Artificial Sequence
  Description of Artificial Sequence: antisense oligonucleotide
ctagtttttccttctcct

SEQ ID NO: 991 - DNA, 18 bp, Artificial Sequence
  Description of Artificial Sequence: antisense oligonucleotide
tctagtttttccttctcc

SEQ ID NO: 992 - DNA, 16 bp, Artificial Sequence
  Description of Artificial Sequence: antisense oligonucleotide
caggatgaactctagt

SEQ ID NO: 993 - DNA, 14 bp, Artificial Sequence
  Description of Artificial Sequence: antisense oligonucleotide
tcgtagaaggtcgt

SEQ ID NO: 994 - DNA, 14 bp, Artificial Sequence
  Description of Artificial Sequence: antisense oligonucleotide
agggttactgtagc

SEQ ID NO: 995 - DNA, 14 bp, Artificial Sequence
  Description of Artificial Sequence: antisense oligonucleotide
gtagtggtgatgtg

SEQ ID NO: 996 - DNA, 14 bp, Artificial Sequence
  Description of Artificial Sequence: antisense oligonucleotide
cgtcgtagaaggtc

SEQ ID NO: 997 - DNA, 14 bp, Artificial Sequence
  Description of Artificial Sequence: antisense oligonucleotide
tttcgtgcacatcc

SEQ ID NO: 998 - DNA, 18 bp, Artificial Sequence
  Description of Artificial Sequence: antisense oligonucleotide
agtttgtagtcgtgaaga

SEQ ID NO: 999 - DNA, 14 bp, Artificial Sequence
  Description of Artificial Sequence: antisense oligonucleotide
cgagaacatcatgg

SEQ ID NO: 1000 - DNA, 14 bp, Artificial Sequence
  Description of Artificial Sequence: antisense oligonucleotide
gtagtaggaaaggc

SEQ ID NO: 1001 - DNA, 14 bp, Artificial Sequence
  Description of Artificial Sequence: antisense oligonucleotide
ggtagtaggaaagg

SEQ ID NO: 1002 - DNA, 14 bp, Artificial Sequence
  Description of Artificial Sequence: antisense oligonucleotide
ggaatggtagtagg

SEQ ID NO: 1003 - DNA, 15 bp, Artificial Sequence
  Description of Artificial Sequence: antisense oligonucleotide
ggtcattgagaagag

SEQ ID NO: 1004 - DNA, 16 bp, Artificial Sequence
  Description of Artificial Sequence: antisense oligonucleotide
gctaatgttcttgacc

SEQ ID NO: 1005 - DNA, 14 bp, Artificial Sequence
  Description of Artificial Sequence: antisense oligonucleotide
gccaaggtcctcat

SEQ ID NO: 1006 - DNA, 14 bp, Artificial Sequence
  Description of Artificial Sequence: antisense oligonucleotide
ggagtctatctcca

SEQ ID NO: 1007 - DNA, 16 bp, Artificial Sequence
  Description of Artificial Sequence: antisense oligonucleotide
ccaaagaatcctgact

SEQ ID NO: 1008 - DNA, 14 bp, Artificial Sequence
  Description of Artificial Sequence: antisense oligonucleotide
cacatgcttagtgg

SEQ ID NO: 1009 - DNA, 14 bp, Artificial Sequence
  Description of Artificial Sequence: antisense oligonucleotide
ctcgtaaatgaccg

SEQ ID NO: 1010 - DNA, 18 bp, Artificial Sequence
  Description of Artificial Sequence: antisense oligonucleotide
aggaatctcgtaaatgac

SEQ ID NO: 1011 - DNA, 14 bp, Artificial Sequence
  Description of Artificial Sequence: antisense oligonucleotide
cagcagcgattcat

SEQ ID NO: 1012 - DNA, 16 bp, Artificial Sequence
  Description of Artificial Sequence: antisense oligonucleotide
ggagatcatcaaagga

SEQ ID NO: 1013 - DNA, 14 bp, Artificial Sequence
  Description of Artificial Sequence: antisense oligonucleotide
ctcagcaatggtca

SEQ ID NO: 1014 - DNA, 14 bp, Artificial Sequence
  Description of Artificial Sequence: antisense oligonucleotide
gatctcgaacacct

SEQ ID NO: 1015 - DNA, 18 bp, Artificial Sequence
  Description of Artificial Sequence: antisense oligonucleotide
cacaatctcgatctttct

SEQ ID NO: 1016 - DNA, 18 bp, Artificial Sequence
  Description of Artificial Sequence: antisense oligonucleotide
ccttcttaaagattggct

SEQ ID NO: 1017 - DNA, 14 bp, Artificial Sequence
  Description of Artificial Sequence: antisense oligonucleotide
cacataccaactgg

SEQ ID NO: 1018 - DNA, 14 bp, Artificial Sequence
  Description of Artificial Sequence: antisense oligonucleotide
agcttgatgtgagg

SEQ ID NO: 1019 - DNA, 18 bp, Artificial Sequence
  Description of Artificial Sequence: antisense oligonucleotide
gaagttgtagcttgatgt

SEQ ID NO: 1020 - DNA, 16 bp, Artificial Sequence
  Description of Artificial Sequence: antisense oligonucleotide
gcttgaagttgtagct

SEQ ID NO: 1021 - DNA, 16 bp, Artificial Sequence
  Description of Artificial Sequence: antisense oligonucleotide
ctgcttgaagttgtag

SEQ ID NO: 1022 - DNA, 14 bp, Artificial Sequence
  Description of Artificial Sequence: antisense oligonucleotide
gacacaactcctct

SEQ ID NO: 1023 - DNA, 18 bp, Artificial Sequence
  Description of Artificial Sequence: antisense oligonucleotide
tcctttgatagacacaac

SEQ ID NO: 1024 - DNA, 16 bp, Artificial Sequence
  Description of Artificial Sequence: antisense oligonucleotide
ctcgtttgatagacac

SEQ ID NO: 1025 - DNA, 14 bp, Artificial Sequence
  Description of Artificial Sequence: antisense oligonucleotide
ggttagcacacact

SEQ ID NO: 1026 - DNA, 14 bp, Artificial Sequence
  Description of Artificial Sequence: antisense oligonucleotide
ggtaacggttagca

SEQ ID NO: 1027 - DNA, 18 bp, Artificial Sequence
  Description of Artificial Sequence: antisense oligonucleotide
cgtaacacatttagaagc

SEQ ID NO: 1028 - DNA, 14 bp, Artificial Sequence
  Description of Artificial Sequence: antisense oligonucleotide
ctcatccgtaacac

SEQ ID NO: 1029 - DNA, 18 bp, Artificial Sequence
  Description of Artificial Sequence: antisense oligonucleotide
ccggtaagtattgtagtt

SEQ ID NO: 1030 - DNA, 16 bp, Artificial Sequence
  Description of Artificial Sequence: antisense oligonucleotide
ggtgtatttccttgac

SEQ ID NO: 1031 - DNA, 16 bp, Artificial Sequence
  Description of Artificial Sequence: antisense oligonucleotide
acataccaactggtgt

SEQ ID NO: 1032 - DNA, 14 bp, Artificial Sequence
  Description of Artificial Sequence: antisense oligonucleotide
gtccctatacgaac

SEQ ID NO: 1033 - DNA, 14 bp, Artificial Sequence
  Description of Artificial Sequence: antisense oligonucleotide
ttcatgtctgtgcc

SEQ ID NO: 1034 - DNA, 14 bp, Artificial Sequence
  Description of Artificial Sequence: antisense oligonucleotide
gtaggtgagttcca

SEQ ID NO: 1035 - DNA, 14 bp, Artificial Sequence
  Description of Artificial Sequence: antisense oligonucleotide
gttgtgagcgatga

SEQ ID NO: 1036 - DNA, 18 bp, Artificial Sequence
  Description of Artificial Sequence: antisense oligonucleotide
catagttgtcctcaaaga

SEQ ID NO: 1037 - DNA, 14 bp, Artificial Sequence
  Description of Artificial Sequence: antisense oligonucleotide
ggcatagttgtcct

SEQ ID NO: 1038 - DNA, 14 bp, Artificial Sequence
  Description of Artificial Sequence: antisense oligonucleotide
cattgtctagcacg

SEQ ID NO: 1039 - DNA, 14 bp, Artificial Sequence
  Description of Artificial Sequence: antisense oligonucleotide
ctccattgtctagc

SEQ ID NO: 1040 - DNA, 14 bp, Artificial Sequence
  Description of Artificial Sequence: antisense oligonucleotide
gtattgttcagcgg

SEQ ID NO: 1041 - DNA, 16 bp, Artificial Sequence
  Description of Artificial Sequence: antisense oligonucleotide
tcaagatctctgtgag

SEQ ID NO: 1042 - DNA, 16 bp, Artificial Sequence
  Description of Artificial Sequence: antisense oligonucleotide
cacaaaatcgtgtcct

SEQ ID NO: 1043 - DNA, 16 bp, Artificial Sequence
  Description of Artificial Sequence: antisense oligonucleotide
tccttccacaaaatcg

SEQ ID NO: 1044 - DNA, 14 bp, Artificial Sequence
  Description of Artificial Sequence: antisense oligonucleotide
gtggaagatgtcct

SEQ ID NO: 1045 - DNA, 16 bp, Artificial Sequence
  Description of Artificial Sequence: antisense oligonucleotide
tcttgtggaagatgtc

SEQ ID NO: 1046 - DNA, 16 bp, Artificial Sequence
  Description of Artificial Sequence: antisense oligonucleotide
tctatcagtgtgagag

SEQ ID NO: 1047 - DNA, 14 bp, Artificial Sequence
  Description of Artificial Sequence: antisense oligonucleotide
ggttggtgtctatc

SEQ ID NO: 1048 - DNA, 14 bp, Artificial Sequence
  Description of Artificial Sequence: antisense oligonucleotide
acatcggagaacag

SEQ ID NO: 1049 - DNA, 14 bp, Artificial Sequence
  Description of Artificial Sequence: antisense oligonucleotide
ccttacacatcgga

SEQ ID NO: 1050 - DNA, 16 bp, Artificial Sequence
  Description of Artificial Sequence: antisense oligonucleotide
acaatcctcagaactc

SEQ ID NO: 1051 - DNA, 14 bp, Artificial Sequence
  Description of Artificial Sequence: antisense oligonucleotide
gctctgacaatcct

SEQ ID NO: 1052 - DNA, 14 bp, Artificial Sequence
  Description of Artificial Sequence: antisense oligonucleotide
tggttgaagtggag

SEQ ID NO: 1053 - DNA, 14 bp, Artificial Sequence
  Description of Artificial Sequence: antisense oligonucleotide
ctgtggttgaagtg

SEQ ID NO: 1054 - DNA, 14 bp, Artificial Sequence
  Description of Artificial Sequence: antisense oligonucleotide
gttgtaggtgacca

SEQ ID NO: 1055 - DNA, 14 bp, Artificial Sequence
  Description of Artificial Sequence: antisense oligonucleotide
ctgtgttgtaggtg

SEQ ID NO: 1056 - DNA, 14 bp, Artificial Sequence
  Description of Artificial Sequence: antisense oligonucleotide
gactcaaacgtgtc

SEQ ID NO: 1057 - DNA, 14 bp, Artificial Sequence
  Description of Artificial Sequence: antisense oligonucleotide
catggactcaaacg

SEQ ID NO: 1058 - DNA, 14 bp, Artificial Sequence
  Description of Artificial Sequence: antisense oligonucleotide
cgaatgtataccgg

SEQ ID NO: 1059 - DNA, 14 bp, Artificial Sequence
  Description of Artificial Sequence: antisense oligonucleotide
ccgaatgtataccg

SEQ ID NO: 1060 - DNA, 14 bp, Artificial Sequence
  Description of Artificial Sequence: antisense oligonucleotide
gccgaatgtatacc

SEQ ID NO: 1061 - DNA, 14 bp, Artificial Sequence
  Description of Artificial Sequence: antisense oligonucleotide
gtagttgtagggac

SEQ ID NO: 1062 - DNA, 18 bp, Artificial Sequence
  Description of Artificial Sequence: antisense oligonucleotide
tagaaaggtagttgtagg

SEQ ID NO: 1063 - DNA, 18 bp, Artificial Sequence
  Description of Artificial Sequence: antisense oligonucleotide
gtagaaaggtagttgtag

SEQ ID NO: 1064 - DNA, 16 bp, Artificial Sequence
  Description of Artificial Sequence: antisense oligonucleotide
cgtagaaaggtagttg

SEQ ID NO: 1065 - DNA, 14 bp, Artificial Sequence
  Description of Artificial Sequence: antisense oligonucleotide
ccgtagaaaggtag

SEQ ID NO: 1066 - DNA, 14 bp, Artificial Sequence
  Description of Artificial Sequence: antisense oligonucleotide
gaccatagcacact

SEQ ID NO: 1067 - DNA, 14 bp, Artificial Sequence
  Description of Artificial Sequence: antisense oligonucleotide
ggatattggcactg

SEQ ID NO: 1068 - DNA, 14 bp, Artificial Sequence
  Description of Artificial Sequence: antisense oligonucleotide
cctggatattggca

SEQ ID NO: 1069 - DNA, 14 bp, Artificial Sequence
  Description of Artificial Sequence: antisense oligonucleotide
gctcccaaagatct

SEQ ID NO: 1070 - DNA, 14 bp, Artificial Sequence
  Description of Artificial Sequence: antisense oligonucleotide
cccatcaaagctct

SEQ ID NO: 1071 - DNA, 14 bp, Artificial Sequence
  Description of Artificial Sequence: antisense oligonucleotide
caaacacttggagc

SEQ ID NO: 1072 - DNA, 16 bp, Artificial Sequence
  Description of Artificial Sequence: antisense oligonucleotide
gtctcaaacacttgga

SEQ ID NO: 1073 - DNA, 16 bp, Artificial Sequence
  Description of Artificial Sequence: antisense oligonucleotide
gagtctcaaacacttg

SEQ ID NO: 1074 - DNA, 16 bp, Artificial Sequence
  Description of Artificial Sequence: antisense oligonucleotide
gtaacctgtgatctct

SEQ ID NO: 1075 - DNA, 14 bp, Artificial Sequence
  Description of Artificial Sequence: antisense oligonucleotide
ggtaacctgtgatc

SEQ ID NO: 1076 - DNA, 16 bp, Artificial Sequence
  Description of Artificial Sequence: antisense oligonucleotide
gtataggtaacctgtg

SEQ ID NO: 1077 - DNA, 18 bp, Artificial Sequence
  Description of Artificial Sequence: antisense oligonucleotide
tgagatgtataggtaacc

SEQ ID NO: 1078 - DNA, 16 bp, Artificial Sequence
  Description of Artificial Sequence: antisense oligonucleotide
tgctgagatgtatagg

SEQ ID NO: 1079 - DNA, 14 bp, Artificial Sequence
  Description of Artificial Sequence: antisense oligonucleotide
ccatgctgagatgt

SEQ ID NO: 1080 - DNA, 14 bp, Artificial Sequence
  Description of Artificial Sequence: antisense oligonucleotide
ggattacttgcagg

SEQ ID NO: 1081 - DNA, 16 bp, Artificial Sequence
  Description of Artificial Sequence: antisense oligonucleotide
tgttatggtggatgag

SEQ ID NO: 1082 - DNA, 14 bp, Artificial Sequence
  Description of Artificial Sequence: antisense oligonucleotide
ggtgttatggtgga

SEQ ID NO: 1083 - DNA, 14 bp, Artificial Sequence
  Description of Artificial Sequence: antisense oligonucleotide
gcagttgacacact

SEQ ID NO: 1084 - DNA, 14 bp, Artificial Sequence
  Description of Artificial Sequence: antisense oligonucleotide
agtactcggcattc

SEQ ID NO: 1085 - DNA, 16 bp, Artificial Sequence
  Description of Artificial Sequence: antisense oligonucleotide
cattcacatactccct

SEQ ID NO: 1086 - DNA, 16 bp, Artificial Sequence
  Description of Artificial Sequence: antisense oligonucleotide
tccaaaacaggtcact

SEQ ID NO: 1087 - DNA, 14 bp, Artificial Sequence
  Description of Artificial Sequence: antisense oligonucleotide
ggtccttatagtgg

SEQ ID NO: 1088 - DNA, 14 bp, Artificial Sequence
  Description of Artificial Sequence: antisense oligonucleotide
cagaatgccaacca

SEQ ID NO: 1089 - DNA, 14 bp, Artificial Sequence
  Description of Artificial Sequence: antisense oligonucleotide
acgagaatgccaac

SEQ ID NO: 1090 - DNA, 14 bp, Artificial Sequence
  Description of Artificial Sequence: antisense oligonucleotide
gatcccaaagacca

SEQ ID NO: 1091 - DNA, 14 bp, Artificial Sequence
  Description of Artificial Sequence: antisense oligonucleotide
tcgcttgatgagga

SEQ ID NO: 1092 - DNA, 14 bp, Artificial Sequence
  Description of Artificial Sequence: antisense oligonucleotide
catcgtgtacttcc

SEQ ID NO: 1093 - DNA, 14 bp, Artificial Sequence
  Description of Artificial Sequence: antisense oligonucleotide
gcatcgtgtacttc

SEQ ID NO: 1094 - DNA, 14 bp, Artificial Sequence
  Description of Artificial Sequence: antisense oligonucleotide
actgtgccaaaagc

SEQ ID NO: 1095 - DNA, 14 bp, Artificial Sequence
  Description of Artificial Sequence: antisense oligonucleotide
cttgtagactgtgc

SEQ ID NO: 1096 - DNA, 14 bp, Artificial Sequence
  Description of Artificial Sequence: antisense oligonucleotide
cccttgtagactgt

SEQ ID NO: 1097 - DNA, 16 bp, Artificial Sequence
  Description of Artificial Sequence: antisense oligonucleotide
tcaacactttgatggc

SEQ ID NO: 1098 - DNA, 14 bp, Artificial Sequence
  Description of Artificial Sequence: antisense oligonucleotide
ccctcaacactttg

SEQ ID NO: 1099 - DNA, 16 bp, Artificial Sequence
  Description of Artificial Sequence: antisense oligonucleotide
gtgttttccctcaaca

SEQ ID NO: 1100 - DNA, 16 bp, Artificial Sequence
  Description of Artificial Sequence: antisense oligonucleotide
gtatgcttcgtctaag

SEQ ID NO: 1101 - DNA, 14 bp, Artificial Sequence
  Description of Artificial Sequence: antisense oligonucleotide
cgtatgcttcgtct

SEQ ID NO: 1102 - DNA, 14 bp, Artificial Sequence
  Description of Artificial Sequence: antisense oligonucleotide
ccatcacgtatgct

SEQ ID NO: 1103 - DNA, 14 bp, Artificial Sequence
  Description of Artificial Sequence: antisense oligonucleotide
gcataagctgtgtc

SEQ ID NO: 1104 - DNA, 14 bp, Artificial Sequence
  Description of Artificial Sequence: antisense oligonucleotide
catggtctaagagg

SEQ ID NO: 1105 - DNA, 16 bp, Artificial Sequence
  Description of Artificial Sequence: antisense oligonucleotide
caatctgcatacacca

SEQ ID NO: 1106 - DNA, 14 bp, Artificial Sequence
  Description of Artificial Sequence: antisense oligonucleotide
ggcaatctgcatac

SEQ ID NO: 1107 - DNA, 14 bp, Artificial Sequence
  Description of Artificial Sequence: antisense oligonucleotide
ctgtctcgtcaatg

SEQ ID NO: 1108 - DNA, 16 bp, Artificial Sequence
  Description of Artificial Sequence: antisense oligonucleotide
cataactccacacatc

SEQ ID NO: 1109 - DNA, 16 bp, Artificial Sequence
  Description of Artificial Sequence: antisense oligonucleotide
agtcacaccataactc

SEQ ID NO: 1110 - DNA, 16 bp, Artificial Sequence
  Description of Artificial Sequence: antisense oligonucleotide
acagtcacaccataac

SEQ ID NO: 1111 - DNA, 14 bp, Artificial Sequence
  Description of Artificial Sequence: antisense oligonucleotide
ccccaaaagtcatc

SEQ ID NO: 1112 - DNA, 14 bp, Artificial Sequence
  Description of Artificial Sequence: antisense oligonucleotide
tcgtaaggtttggc

SEQ ID NO: 1113 - DNA, 14 bp, Artificial Sequence
  Description of Artificial Sequence: antisense oligonucleotide
gatcccatcgtaag

SEQ ID NO: 1114 - DNA, 14 bp, Artificial Sequence
  Description of Artificial Sequence: antisense oligonucleotide
caatggtgcagatg

SEQ ID NO: 1115 - DNA, 14 bp, Artificial Sequence
  Description of Artificial Sequence: antisense oligonucleotide
gacatcaatggtgc

SEQ ID NO: 1116 - DNA, 16 bp, Artificial Sequence
  Description of Artificial Sequence: antisense oligonucleotide
gtagacatcaatggtg

SEQ ID NO: 1117 - DNA, 18 bp, Artificial Sequence
  Description of Artificial Sequence: antisense oligonucleotide
catgatcatgtagacatc

SEQ ID NO: 1118 - DNA, 16 bp, Artificial Sequence
  Description of Artificial Sequence: antisense oligonucleotide
ccatgatcatgtagac

SEQ ID NO: 1119 - DNA, 18 bp, Artificial Sequence
  Description of Artificial Sequence: antisense oligonucleotide
catttgaccatgatcatg

SEQ ID NO: 1120 - DNA, 16 bp, Artificial Sequence
  Description of Artificial Sequence: antisense oligonucleotide
ccaacatttgaccatg

SEQ ID NO: 1121 - DNA, 18 bp, Artificial Sequence
  Description of Artificial Sequence: antisense oligonucleotide
tcatccaacatttgacca

SEQ ID NO: 1122 - DNA, 18 bp, Artificial Sequence
  Description of Artificial Sequence: antisense oligonucleotide
gagtcaatcatccaacat

SEQ ID NO: 1123 - DNA, 16 bp, Artificial Sequence
  Description of Artificial Sequence: antisense oligonucleotide
cagagtcaatcatcca

SEQ ID NO: 1124 - DNA, 14 bp, Artificial Sequence
  Description of Artificial Sequence: antisense oligonucleotide
ccgacattcagagt

SEQ ID NO: 1125 - DNA, 16 bp, Artificial Sequence
  Description of Artificial Sequence: antisense oligonucleotide
gaattcagacaccaac

SEQ ID NO: 1126 - DNA, 14 bp, Artificial Sequence
  Description of Artificial Sequence: antisense oligonucleotide
gatgaccacaaagc

SEQ ID NO: 1127 - DNA, 16 bp, Artificial Sequence
  Description of Artificial Sequence: antisense oligonucleotide
ccatcaaatacatcgg

SEQ ID NO: 1128 - DNA, 18 bp, Artificial Sequence
  Description of Artificial Sequence: antisense oligonucleotide
tcaccatcaaatacatcg

SEQ ID NO: 1129 - DNA, 14 bp, Artificial Sequence
  Description of Artificial Sequence: antisense oligonucleotide
caacgtagccatca

SEQ ID NO: 1130 - DNA, 14 bp, Artificial Sequence
  Description of Artificial Sequence: antisense oligonucleotide
acgtctttgacgac

SEQ ID NO: 1131 - DNA, 18 bp, Artificial Sequence
  Description of Artificial Sequence: antisense oligonucleotide
caaaaacgtctttgacga

SEQ ID NO: 1132 - DNA, 16 bp, Artificial Sequence
  Description of Artificial Sequence: antisense oligonucleotide
ggcaaaaacgtctttg

SEQ ID NO: 1133 - DNA, 16 bp, Artificial Sequence
  Description of Artificial Sequence: antisense oligonucleotide
caaaggcaaaaacgtc

SEQ ID NO: 1134 - DNA, 14 bp, Artificial Sequence
  Description of Artificial Sequence: antisense oligonucleotide
gtgtcaagtactcg

SEQ ID NO: 1135 - DNA, 16 bp, Artificial Sequence
  Description of Artificial Sequence: antisense oligonucleotide
gtaatagaggttgtcg

SEQ ID NO: 1136 - DNA, 14 bp, Artificial Sequence
  Description of Artificial Sequence: antisense oligonucleotide
cccagtaatagagg

SEQ ID NO: 1137 - DNA, 14 bp, Artificial Sequence
  Description of Artificial Sequence: antisense oligonucleotide
catggtgctcactg

SEQ ID NO: 1138 - DNA, 14 bp, Artificial Sequence
  Description of Artificial Sequence: antisense oligonucleotide
gtgcctgtacgtac

SEQ ID NO: 1139 - DNA, 14 bp, Artificial Sequence
  Description of Artificial Sequence: antisense oligonucleotide
tgcaggtggatagt

SEQ ID NO: 1140 - DNA, 18 bp, Artificial Sequence
  Description of Artificial Sequence: antisense oligonucleotide
catgtcgatagtcttgca

SEQ ID NO: 1141 - DNA, 14 bp, Artificial Sequence
  Description of Artificial Sequence: antisense oligonucleotide
gtcgatagtcttgc

SEQ ID NO: 1142 - DNA, 14 bp, Artificial Sequence
  Description of Artificial Sequence: antisense oligonucleotide
ccatgtcgatagtc

SEQ ID NO: 1143 - DNA, 14 bp, Artificial Sequence
  Description of Artificial Sequence: antisense oligonucleotide
ctccatgtcgatag

SEQ ID NO: 1144 - DNA, 14 bp, Artificial Sequence
  Description of Artificial Sequence: antisense oligonucleotide
cttggacaggatct

SEQ ID NO: 1145 - DNA, 14 bp, Artificial Sequence
  Description of Artificial Sequence: antisense oligonucleotide
tgctgttgtacagg

SEQ ID NO: 1146 - DNA, 14 bp, Artificial Sequence
  Description of Artificial Sequence: antisense oligonucleotide
gtgctgttgtacag

SEQ ID NO: 1147 - DNA, 14 bp, Artificial Sequence
  Description of Artificial Sequence: antisense oligonucleotide
ttggcgtagtagtc

SEQ ID NO: 1148 - DNA, 14 bp, Artificial Sequence
  Description of Artificial Sequence: antisense oligonucleotide
tccaccattagcac

SEQ ID NO: 1149 - DNA, 14 bp, Artificial Sequence
  Description of Artificial Sequence: antisense oligonucleotide
gatttcgttgtggg

SEQ ID NO: 1150 - DNA, 18 bp, Artificial Sequence
  Description of Artificial Sequence: antisense oligonucleotide
gtcatagatttcgttgtg

SEQ ID NO: 1151 - DNA, 16 bp, Artificial Sequence
  Description of Artificial Sequence: antisense oligonucleotide
tgtactctgcttgaac

SEQ ID NO: 1152 - DNA, 14 bp, Artificial Sequence
  Description of Artificial Sequence: antisense oligonucleotide
gtgtactctgcttg

SEQ ID NO: 1153 - DNA, 14 bp, Artificial Sequence
  Description of Artificial Sequence: antisense oligonucleotide
tgctgtgtgtactc

SEQ ID NO: 1154 - DNA, 18 bp, Artificial Sequence
  Description of Artificial Sequence: antisense oligonucleotide
ctgatgtgttgaagaaca

SEQ ID NO: 1155 - DNA, 16 bp, Artificial Sequence
  Description of Artificial Sequence: antisense oligonucleotide
ctctgatgtgttgaag

SEQ ID NO: 1156 - DNA, 14 bp, Artificial Sequence
  Description of Artificial Sequence: antisense oligonucleotide
gctctgatgtgttg

SEQ ID NO: 1157 - DNA, 14 bp, Artificial Sequence
  Description of Artificial Sequence: antisense oligonucleotide
gagctctgatgtgt

SEQ ID NO: 1158 - DNA, 18 bp, Artificial Sequence
  Description of Artificial Sequence: antisense oligonucleotide
cacttttaacttgagcct

SEQ ID NO: 1159 - DNA, 18 bp, Artificial Sequence
  Description of Artificial Sequence: antisense oligonucleotide
ctccacttttaacttgag

SEQ ID NO: 1160 - DNA, 18 bp, Artificial Sequence
  Description of Artificial Sequence: antisense oligonucleotide
tgctgtatttctggtaca

SEQ ID NO: 1161 - DNA, 14 bp, Artificial Sequence
  Description of Artificial Sequence: antisense oligonucleotide
ccaggaattgttgc

SEQ ID NO: 1162 - DNA, 14 bp, Artificial Sequence
  Description of Artificial Sequence: antisense oligonucleotide
ttgctgaggtatcg

SEQ ID NO: 1163 - DNA, 14 bp, Artificial Sequence
  Description of Artificial Sequence: antisense oligonucleotide
gataaccactctgg

SEQ ID NO: 1164 - DNA, 18 bp, Artificial Sequence
  Description of Artificial Sequence: antisense oligonucleotide
caaaagataaccactctg

SEQ ID NO: 1165 - DNA, 15 bp, Artificial Sequence
  Description of Artificial Sequence: antisense oligonucleotide
cggtgacatcaaaag

SEQ ID NO: 1166 - DNA, 14 bp, Artificial Sequence
  Description of Artificial Sequence: antisense oligonucleotide
cctcaatttcccct

SEQ ID NO: 1167 - DNA, 14 bp, Artificial Sequence
  Description of Artificial Sequence: antisense oligonucleotide
gttatccctgctgt

SEQ ID NO: 1168 - DNA, 14 bp, Artificial Sequence
  Description of Artificial Sequence: antisense oligonucleotide
gcagtgtgttatcc

SEQ ID NO: 1169 - DNA, 14 bp, Artificial Sequence
  Description of Artificial Sequence: antisense oligonucleotide
gatgtccacttgca

SEQ ID NO: 1170 - DNA, 14 bp, Artificial Sequence
  Description of Artificial Sequence: antisense oligonucleotide
tagtgaacccgttg

SEQ ID NO: 1171 - DNA, 14 bp, Artificial Sequence
  Description of Artificial Sequence: antisense oligonucleotide
tgccatgaatggtg

SEQ ID NO: 1172 - DNA, 16 bp, Artificial Sequence
  Description of Artificial Sequence: antisense oligonucleotide
gttcatgccatgaatg

SEQ ID NO: 1173 - DNA, 14 bp, Artificial Sequence
  Description of Artificial Sequence: antisense oligonucleotide
catgagaagcagga

SEQ ID NO: 1174 - DNA, 14 bp, Artificial Sequence
  Description of Artificial Sequence: antisense oligonucleotide
gctttgcagatgct

SEQ ID NO: 1175 - DNA, 14 bp, Artificial Sequence
  Description of Artificial Sequence: antisense oligonucleotide
gagctttgcagatg

SEQ ID NO: 1176 - DNA, 14 bp, Artificial Sequence
  Description of Artificial Sequence: antisense oligonucleotide
tagttggtgtccag

SEQ ID NO: 1177 - DNA, 16 bp, Artificial Sequence
  Description of Artificial Sequence: antisense oligonucleotide
ctgaagcaatagttgg

SEQ ID NO: 1178 - DNA, 18 bp, Artificial Sequence
  Description of Artificial Sequence: antisense oligonucleotide
agctgaagcaatagttgg

SEQ ID NO: 1179 - DNA, 14 bp, Artificial Sequence
  Description of Artificial Sequence: antisense oligonucleotide
ggagctgaagcaat

SEQ ID NO: 1180 - DNA, 14 bp, Artificial Sequence
  Description of Artificial Sequence: antisense oligonucleotide
caatgtacagctgc

SEQ ID NO: 1181 - DNA, 16 bp, Artificial Sequence
  Description of Artificial Sequence: antisense oligonucleotide
ggaagtcaatgtacag

SEQ ID NO: 1182 - DNA, 15 bp, Artificial Sequence
  Description of Artificial Sequence: antisense oligonucleotide
cggaagtcaatgtac

SEQ ID NO: 1183 - DNA, 14 bp, Artificial Sequence
  Description of Artificial Sequence: antisense oligonucleotide
gcggaagtcaatgt

SEQ ID NO: 1184 - DNA, 14 bp, Artificial Sequence
  Description of Artificial Sequence: antisense oligonucleotide
agttggcatggtag

SEQ ID NO: 1185 - DNA, 14 bp, Artificial Sequence
  Description of Artificial Sequence: antisense oligonucleotide
gcagaagttggcat

SEQ ID NO: 1186 - DNA, 14 bp, Artificial Sequence
  Description of Artificial Sequence: antisense oligonucleotide
ctccaaatgtaggg

SEQ ID NO: 1187 - DNA, 14 bp, Artificial Sequence
  Description of Artificial Sequence: antisense oligonucleotide
accttgctgtactg

SEQ ID NO: 1188 - DNA, 14 bp, Artificial Sequence
  Description of Artificial Sequence: antisense oligonucleotide
tgctggttgtacag

SEQ ID NO: 1189 - DNA, 14 bp, Artificial Sequence
  Description of Artificial Sequence: antisense oligonucleotide
ggttatgctggttg

SEQ ID NO: 1190 - DNA, 14 bp, Artificial Sequence
  Description of Artificial Sequence: antisense oligonucleotide
gtagtacacgatgg

SEQ ID NO: 1191 - DNA, 14 bp, Artificial Sequence
  Description of Artificial Sequence: antisense oligonucleotide
cgtagtacacgatg

SEQ ID NO: 1192 - DNA, 14 bp, Artificial Sequence
  Description of Artificial Sequence: antisense oligonucleotide
cacgtagtacacga

SEQ ID NO: 1193 - DNA, 14 bp, Artificial Sequence
  Description of Artificial Sequence: antisense oligonucleotide
catgttggacagct

SEQ ID NO: 1194 - DNA, 14 bp, Artificial Sequence
  Description of Artificial Sequence: antisense oligonucleotide
gcacgatcatgttg

SEQ ID NO: 1195 - DNA, 14 bp, Artificial Sequence
  Description of Artificial Sequence: antisense oligonucleotide
cacacagtagtgca

SEQ ID NO: 1196 - DNA, 14 bp, Artificial Sequence
  Description of Artificial Sequence: antisense oligonucleotide
gatcagaaaagcgc

SEQ ID NO: 1197 - DNA, 14 bp, Artificial Sequence
  Description of Artificial Sequence: antisense oligonucleotide
accgtgaccagatg

SEQ ID NO: 1198 - DNA, 14 bp, Artificial Sequence
  Description of Artificial Sequence: antisense oligonucleotide
gtagacaggctgag

SEQ ID NO: 1199 - DNA, 14 bp, Artificial Sequence
  Description of Artificial Sequence: antisense oligonucleotide
tatcgagtgtgctg

SEQ ID NO: 1200 - DNA, 14 bp, Artificial Sequence
  Description of Artificial Sequence: antisense oligonucleotide
ttgcgcatgaactg

SEQ ID NO: 1201 - DNA, 14 bp, Artificial Sequence
  Description of Artificial Sequence: antisense oligonucleotide
ttgctcaggatctg

SEQ ID NO: 1202 - DNA, 14 bp, Artificial Sequence
  Description of Artificial Sequence: antisense oligonucleotide
actggtgagcttca

SEQ ID NO: 1203 - DNA, 14 bp, Artificial Sequence
  Description of Artificial Sequence: antisense oligonucleotide
gctcaggatagtct

SEQ ID NO: 1204 - DNA, 18 bp, Artificial Sequence
  Description of Artificial Sequence: antisense oligonucleotide
tgtagatggaaatcacct

SEQ ID NO: 1205 - DNA, 14 bp, Artificial Sequence
  Description of Artificial Sequence: antisense oligonucleotide
tggtgctgttgtag

SEQ ID NO: 1206 - DNA, 14 bp, Artificial Sequence
  Description of Artificial Sequence: antisense oligonucleotide
ttctcctggagcaa

SEQ ID NO: 1207 - DNA, 14 bp, Artificial Sequence
  Description of Artificial Sequence: antisense oligonucleotide
tactcttcgtcgct

SEQ ID NO: 1208 - DNA, 14 bp, Artificial Sequence
  Description of Artificial Sequence: antisense oligonucleotide
cttggcgtagtact

SEQ ID NO: 1209 - DNA, 18 bp, Artificial Sequence
  Description of Artificial Sequence: antisense oligonucleotide
cggcatgtctattttgta

SEQ ID NO: 1210 - DNA, 14 bp, Artificial Sequence
  Description of Artificial Sequence: antisense oligonucleotide
cgggatggcatttt

SEQ ID NO: 1211 - DNA, 14 bp, Artificial Sequence
  Description of Artificial Sequence: antisense oligonucleotide
ctgtagaaagtggg

SEQ ID NO: 1212 - DNA, 18 bp, Artificial Sequence
  Description of Artificial Sequence: antisense oligonucleotide
acaattctgaagtagggt

SEQ ID NO: 1213 - DNA, 18 bp, Artificial Sequence
  Description of Artificial Sequence: antisense oligonucleotide
attgctgagacgtcaaat

SEQ ID NO: 1214 - DNA, 14 bp, Artificial Sequence
  Description of Artificial Sequence: antisense oligonucleotide
tctccattgctgag

SEQ ID NO: 1215 - DNA, 18 bp, Artificial Sequence
  Description of Artificial Sequence: antisense oligonucleotide
tcaccaaattggaagcat

SEQ ID NO: 1216 - DNA, 14 bp, Artificial Sequence
  Description of Artificial Sequence: antisense oligonucleotide
ctctgaactctgct

SEQ ID NO: 1217 - DNA, 18 bp, Artificial Sequence
  Description of Artificial Sequence: antisense oligonucleotide
aacgaaagactctgaact

SEQ ID NO: 1218 - DNA, 14 bp, Artificial Sequence
  Description of Artificial Sequence: antisense oligonucleotide
tgggttctgcaaac

SEQ ID NO: 1219 - DNA, 14 bp, Artificial Sequence
  Description of Artificial Sequence: antisense oligonucleotide
ctggcttttgggtt

SEQ ID NO: 1220 - DNA, 14 bp, Artificial Sequence
  Description of Artificial Sequence: antisense oligonucleotide
gttgttcaggcact

SEQ ID NO: 1221 - DNA, 18 bp, Artificial Sequence
  Description of Artificial Sequence: antisense oligonucleotide
tctgatatagctcaatcc

SEQ ID NO: 1222 - DNA, 18 bp, Artificial Sequence
  Description of Artificial Sequence: antisense oligonucleotide
tctttggacttgagaatc

SEQ ID NO: 1223 - DNA, 14 bp, Artificial Sequence
  Description of Artificial Sequence: antisense oligonucleotide
tgggttggagatgt

SEQ ID NO: 1224 - DNA, 14 bp, Artificial Sequence
  Description of Artificial Sequence: antisense oligonucleotide
tgctgtcgatgtag

SEQ ID NO: 1225 - DNA, 16 bp, Artificial Sequence
  Description of Artificial Sequence: antisense oligonucleotide
acaactttgctgtcga

SEQ ID NO: 1226 - DNA, 14 bp, Artificial Sequence
  Description of Artificial Sequence: antisense oligonucleotide
attcgccttctgct

SEQ ID NO: 1227 - DNA, 14 bp, Artificial Sequence
  Description of Artificial Sequence: antisense oligonucleotide
gaaggagagccatt

SEQ ID NO: 1228 - DNA, 16 bp, Artificial Sequence
  Description of Artificial Sequence: antisense oligonucleotide
tcagttacatcgaagg

SEQ ID NO: 1229 - DNA, 18 bp, Artificial Sequence
  Description of Artificial Sequence: antisense oligonucleotide
tgaagccattcatgaaca

SEQ ID NO: 1230 - DNA, 16 bp, Artificial Sequence
  Description of Artificial Sequence: antisense oligonucleotide
tcctgtctttatggtg

SEQ ID NO: 1231 - DNA, 14 bp, Artificial Sequence
  Description of Artificial Sequence: antisense oligonucleotide
aaatcccaggttcc

SEQ ID NO: 1232 - DNA, 18 bp, Artificial Sequence
  Description of Artificial Sequence: antisense oligonucleotide
ggacagtgtaagcttatt

SEQ ID NO: 1233 - DNA, 16 bp, Artificial Sequence
  Description of Artificial Sequence: antisense oligonucleotide
gtacaaaagtgcagca

SEQ ID NO: 1234 - DNA, 18 bp, Artificial Sequence
  Description of Artificial Sequence: antisense oligonucleotide
tagatggtacaaaagtgc

SEQ ID NO: 1235 - DNA, 20 bp, Artificial Sequence
  Description of Artificial Sequence: antisense oligonucleotide
cacttttatttgggatgatg

SEQ ID NO: 1236 - DNA, 18 bp, Artificial Sequence
  Description of Artificial Sequence: antisense oligonucleotide
gcaaatcttgcttctagt

SEQ ID NO: 1237 - DNA, 14 bp, Artificial Sequence
  Description of Artificial Sequence: antisense oligonucleotide
gtgccatcaatacc

SEQ ID NO: 1238 - DNA, 14 bp, Artificial Sequence
  Description of Artificial Sequence: antisense oligonucleotide
ggtatatgtggagg

SEQ ID NO: 1239 - DNA, 14 bp, Artificial Sequence
  Description of Artificial Sequence: antisense oligonucleotide
tctgatcaccactg

SEQ ID NO: 1240 - DNA, 18 bp, Artificial Sequence
  Description of Artificial Sequence: antisense oligonucleotide
tcctagtggactttatag

SEQ ID NO: 1241 - DNA, 16 bp, Artificial Sequence
  Description of Artificial Sequence: antisense oligonucleotide
tttttcctagtggact

SEQ ID NO: 1242 - DNA, 16 bp, Artificial Sequence
  Description of Artificial Sequence: antisense oligonucleotide
caataacattagcagg

SEQ ID NO: 1243 - DNA, 14 bp, Artificial Sequence
  Description of Artificial Sequence: antisense oligonucleotide
aagtctgtaggagg

SEQ ID NO: 1244 - DNA, 16 bp, Artificial Sequence
  Description of Artificial Sequence: antisense oligonucleotide
tctgttgtgactcaag

SEQ ID NO: 1245 - DNA, 14 bp, Artificial Sequence
  Description of Artificial Sequence: antisense oligonucleotide
gttggtctgttgtg

SEQ ID NO: 1246 - DNA, 14 bp, Artificial Sequence
  Description of Artificial Sequence: antisense oligonucleotide
caaagcacgcttct

SEQ ID NO: 1247 - DNA, 18 bp, Artificial Sequence
  Description of Artificial Sequence: antisense oligonucleotide
tttctaaagcaataggcc

SEQ ID NO: 1248 - DNA, 16 bp, Artificial Sequence
  Description of Artificial Sequence: antisense oligonucleotide
gcaattatcctgcaca

SEQ ID NO: 1249 - DNA, 14 bp, Artificial Sequence
  Description of Artificial Sequence: antisense oligonucleotide
acgtaggcagcaat

SEQ ID NO: 1250 - DNA, 18 bp, Artificial Sequence
  Description of Artificial Sequence: antisense oligonucleotide
atcaatgtaaagtggacg

SEQ ID NO: 1251 - DNA, 14 bp, Artificial Sequence
  Description of Artificial Sequence: antisense oligonucleotide
ctagatccctcttg

SEQ ID NO: 1252 - DNA, 14 bp, Artificial Sequence
  Description of Artificial Sequence: antisense oligonucleotide
ccatttccacccta

SEQ ID NO: 1253 - DNA, 14 bp, Artificial Sequence
  Description of Artificial Sequence: antisense oligonucleotide
tgggttcgtgtatc

SEQ ID NO: 1254 - DNA, 14 bp, Artificial Sequence
  Description of Artificial Sequence: antisense oligonucleotide
tggcattgtaccct

SEQ ID NO: 1255 - DNA, 14 bp, Artificial Sequence
  Description of Artificial Sequence: antisense oligonucleotide
tccagcacagaagt

SEQ ID NO: 1256 - DNA, 16 bp, Artificial Sequence
  Description of Artificial Sequence: antisense oligonucleotide
ataaatacgggcatgc

SEQ ID NO: 1257 - DNA, 14 bp, Artificial Sequence
  Description of Artificial Sequence: antisense oligonucleotide
agtgtctgaactcc

SEQ ID NO: 1258 - DNA, 14 bp, Artificial Sequence
  Description of Artificial Sequence: antisense oligonucleotide
tgtgctgagtgtct

SEQ ID NO: 1259 - DNA, 14 bp, Artificial Sequence
  Description of Artificial Sequence: antisense oligonucleotide
ataagctcaggacc

SEQ ID NO: 1260 - DNA, 14 bp, Artificial Sequence
  Description of Artificial Sequence: antisense oligonucleotide
aggagaagcagatg

SEQ ID NO: 1261 - DNA, 14 bp, Artificial Sequence
  Description of Artificial Sequence: antisense oligonucleotide
agcaaggagaagca

SEQ ID NO: 1262 - DNA, 14 bp, Artificial Sequence
  Description of Artificial Sequence: antisense oligonucleotide
aatcttgggacacg

SEQ ID NO: 1263 - DNA, 18 bp, Artificial Sequence
  Description of Artificial Sequence: antisense oligonucleotide
tagagaatggttagaggt

SEQ ID NO: 1264 - DNA, 18 bp, Artificial Sequence
  Description of Artificial Sequence: antisense oligonucleotide
gttttgccaatgtagtag

SEQ ID NO: 1265 - DNA, 14 bp, Artificial Sequence
  Description of Artificial Sequence: antisense oligonucleotide
cttgggtgttttgc

SEQ ID NO: 1266 - DNA, 16 bp, Artificial Sequence
  Description of Artificial Sequence: antisense oligonucleotide
gcaagactttacaatc

SEQ ID NO: 1267 - DNA, 18 bp, Artificial Sequence
  Description of Artificial Sequence: antisense oligonucleotide
gcatttgcaagactttac

SEQ ID NO: 1268 - DNA, 18 bp, Artificial Sequence
  Description of Artificial Sequence: antisense oligonucleotide
tttagctgcatttgcaag

SEQ ID NO: 1269 - DNA, 14 bp, Artificial Sequence
  Description of Artificial Sequence: antisense oligonucleotide
gccacttttccaag

SEQ ID NO: 1270 - DNA, 14 bp, Artificial Sequence
  Description of Artificial Sequence: antisense oligonucleotide
ttggtcttgccact

SEQ ID NO: 1271 - DNA, 14 bp, Artificial Sequence
  Description of Artificial Sequence: antisense oligonucleotide
cagcacacagtagt

SEQ ID NO: 1272 - DNA, 14 bp, Artificial Sequence
  Description of Artificial Sequence: antisense oligonucleotide
cgatagtcttgcag

SEQ ID NO: 1273 - DNA, 18 bp, Artificial Sequence
  Description of Artificial Sequence: antisense oligonucleotide
ctttcaccaaattggaag

SEQ ID NO: 1274 - DNA, 15 bp, Artificial Sequence
  Description of Artificial Sequence: antisense oligonucleotide
caccaaattggaagc

SEQ ID NO: 1275 - DNA, 16 bp, Artificial Sequence
  Description of Artificial Sequence: antisense oligonucleotide
tcaccaaattggaagc

SEQ ID NO: 1276 - DNA, 14 bp, Artificial Sequence
  Description of Artificial Sequence: antisense oligonucleotide
ctctggcttttggg

SEQ ID NO: 1277 - DNA, 16 bp, Artificial Sequence
  Description of Artificial Sequence: antisense oligonucleotide
cggcatgtctattttg

SEQ ID NO: 1278 - DNA, 14 bp, Artificial Sequence
  Description of Artificial Sequence: antisense oligonucleotide
cactacagacgagc

SEQ ID NO: 1279 - DNA, 15 bp, Artificial Sequence
  Description of Artificial Sequence: antisense oligonucleotide
cgtgcactacagacg

SEQ ID NO: 1280 - DNA, 14 bp, Artificial Sequence
  Description of Artificial Sequence: antisense oligonucleotide
ggaacagttcgtcc

SEQ ID NO: 1281 - DNA, 16 bp, Artificial Sequence
  Description of Artificial Sequence: antisense oligonucleotide
gaacagttcgtccatg

SEQ ID NO: 1282 - DNA, 15 bp, Artificial Sequence
  Description of Artificial Sequence: antisense oligonucleotide
ccagagtttcggttc

SEQ ID NO: 1283 - DNA, 15 bp, Artificial Sequence
  Description of Artificial Sequence: antisense oligonucleotide
ctaggactgggacag

SEQ ID NO: 1284 - DNA, 13 bp, Artificial Sequence
  Description of Artificial Sequence: antisense oligonucleotide
cgcacttgtagcg

SEQ ID NO: 1285 - DNA, 14 bp, Artificial Sequence
  Description of Artificial Sequence: antisense oligonucleotide
ctcgcacttgtagc

SEQ ID NO: 1286 - DNA, 11 bp, Artificial Sequence
  Description of Artificial Sequence: antisense oligonucleotide
gcacttgtagc

SEQ ID NO: 1287 - DNA, 14 bp, Artificial Sequence
  Description of Artificial Sequence: antisense oligonucleotide
gcgcactgtccctg

SEQ ID NO: 1288 - DNA, 14 bp, Artificial Sequence
  Description of Artificial Sequence: antisense oligonucleotide
ccagggagatgcgc

SEQ ID NO: 1289 - DNA, 13 bp, Artificial Sequence
  Description of Artificial Sequence: antisense oligonucleotide
gccggtgaggagg

SEQ ID NO: 1290 - DNA, 13 bp, Artificial Sequence
  Description of Artificial Sequence: antisense oligonucleotide
ccggtgaggaggg

SEQ ID NO: 1291 - DNA, 13 bp, Artificial Sequence
  Description of Artificial Sequence: antisense oligonucleotide
cggttcactcggc

SEQ ID NO: 1292 - DNA, 16 bp, Artificial Sequence
  Description of Artificial Sequence: antisense oligonucleotide
gagtttcggttcactc

SEQ ID NO: 1293 - DNA, 16 bp, Artificial Sequence
  Description of Artificial Sequence: antisense oligonucleotide
ggcacgattgtcaaag

SEQ ID NO: 1294 - DNA, 14 bp, Artificial Sequence
  Description of Artificial Sequence: antisense oligonucleotide
caggcgtcaccccc

SEQ ID NO: 1295 - DNA, 13 bp, Artificial Sequence
  Description of Artificial Sequence: antisense oligonucleotide
gcaggcgtcaccc

SEQ ID NO: 1296 - DNA, 13 bp, Artificial Sequence
  Description of Artificial Sequence: antisense oligonucleotide
ctccctcctaagc

SEQ ID NO: 1297 - DNA, 13 bp, Artificial Sequence
  Description of Artificial Sequence: antisense oligonucleotide
ccctcctaagcgg

SEQ ID NO: 1298 - DNA, 14 bp, Artificial Sequence
  Description of Artificial Sequence: antisense oligonucleotide
cgagtccgcgttcg

SEQ ID NO: 1299 - DNA, 15 bp, Artificial Sequence
  Description of Artificial Sequence: antisense oligonucleotide
catcttctgccattc

SEQ ID NO: 1300 - DNA, 15 bp, Artificial Sequence
  Description of Artificial Sequence: antisense oligonucleotide
gtgttttcccaccag

SEQ ID NO: 1301 - DNA, 16 bp, Artificial Sequence
  Description of Artificial Sequence: antisense oligonucleotide
ggttttggttcactag

SEQ ID NO: 1302 - DNA, 16 bp, Artificial Sequence
  Description of Artificial Sequence: antisense oligonucleotide
gcatcttcacgtctcc

SEQ ID NO: 1303 - DNA, 16 bp, Artificial Sequence
  Description of Artificial Sequence: antisense oligonucleotide
cttcacgtctcctgtc

SEQ ID NO: 1304 - DNA, 14 bp, Artificial Sequence
  Description of Artificial Sequence: antisense oligonucleotide
gtcaccgcgtagtc

SEQ ID NO: 1305 - DNA, 15 bp, Artificial Sequence
  Description of Artificial Sequence: antisense oligonucleotide
caaataggcaaggtc

SEQ ID NO: 1306 - DNA, 16 bp, Artificial Sequence
  Description of Artificial Sequence: antisense oligonucleotide
cttgcaaataggcaag

SEQ ID NO: 1307 - DNA, 14 bp, Artificial Sequence
  Description of Artificial Sequence: antisense oligonucleotide
tgcttgcaaatagg

SEQ ID NO: 1308 - DNA, 15 bp, Artificial Sequence
  Description of Artificial Sequence: antisense oligonucleotide
ctgcttgcaaatagg

SEQ ID NO: 1309 - DNA, 14 bp, Artificial Sequence
  Description of Artificial Sequence: antisense oligonucleotide
gcaggtggatattt

SEQ ID NO: 1310 - DNA, 13 bp, Artificial Sequence
  Description of Artificial Sequence: antisense oligonucleotide
ctgctgttggcag

SEQ ID NO: 1311 - DNA, 15 bp, Artificial Sequence
  Description of Artificial Sequence: antisense oligonucleotide
cactagtttccaagt

SEQ ID NO: 1312 - DNA, 15 bp, Artificial Sequence
  Description of Artificial Sequence: antisense oligonucleotide
gttttggttcactag

SEQ ID NO: 1313 - DNA, 17 bp, Artificial Sequence
  Description of Artificial Sequence: antisense oligonucleotide
ctttgatttcaggatag

SEQ ID NO: 1314 - DNA, 17 bp, Artificial Sequence
  Description of Artificial Sequence: antisense oligonucleotide
gcacttcttctttatct

SEQ ID NO: 1315 - DNA, 15 bp, Artificial Sequence
  Description of Artificial Sequence: antisense oligonucleotide
ccaagtcagatttcc

SEQ ID NO: 1316 - DNA, 18 bp, Artificial Sequence
  Description of Artificial Sequence: antisense oligonucleotide
gtttccaagtcagatttc

SEQ ID NO: 1317 - DNA, 15 bp, Artificial Sequence
  Description of Artificial Sequence: antisense oligonucleotide
ggttcactagtttcc

SEQ ID NO: 1318 - DNA, 16 bp, Artificial Sequence
  Description of Artificial Sequence: antisense oligonucleotide
ggttttggttcactag

SEQ ID NO: 1319 - DNA, 15 bp, Artificial Sequence
  Description of Artificial Sequence: antisense oligonucleotide
ccgaaaaattgggca

SEQ ID NO: 1320 - DNA, 13 bp, Artificial Sequence
  Description of Artificial Sequence: antisense oligonucleotide
ccgaaaaattggg

SEQ ID NO: 1321 - DNA, 16 bp, Artificial Sequence
  Description of Artificial Sequence: antisense oligonucleotide
ctatccgaaaaattgg

SEQ ID NO: 1322 - DNA, 17 bp, Artificial Sequence
  Description of Artificial Sequence: antisense oligonucleotide
gttgataatgtcatcag

SEQ ID NO: 1323 - DNA, 17 bp, Artificial Sequence
  Description of Artificial Sequence: antisense oligonucleotide
ctcatgttgataatgtc

SEQ ID NO: 1324 - DNA, 14 bp, Artificial Sequence
  Description of Artificial Sequence: antisense oligonucleotide
ctgtcaccgcgtag

SEQ ID NO: 1325 - DNA, 15 bp, Artificial Sequence
  Description of Artificial Sequence: antisense oligonucleotide
cgtctcctgtcaccg

SEQ ID NO: 1326 - DNA, 14 bp, Artificial Sequence
  Description of Artificial Sequence: antisense oligonucleotide
cttcacgtctcctg

SEQ ID NO: 1327 - DNA, 17 bp, Artificial Sequence
  Description of Artificial Sequence: antisense oligonucleotide
gagaactttatcatgtc

SEQ ID NO: 1328 - DNA, 13 bp, Artificial Sequence
  Description of Artificial Sequence: antisense oligonucleotide
gctatatgcaggg

SEQ ID NO: 1329 - DNA, 18 bp, Artificial Sequence
  Description of Artificial Sequence: antisense oligonucleotide
ccagctgctatatgcagg

SEQ ID NO: 1330 - DNA, 16 bp, Artificial Sequence
  Description of Artificial Sequence: antisense oligonucleotide
aggctaaattttgcct

SEQ ID NO: 1331 - DNA, 14 bp, Artificial Sequence
  Description of Artificial Sequence: antisense oligonucleotide
ggctaaattttgcc

SEQ ID NO: 1332 - DNA, 17 bp, Artificial Sequence
  Description of Artificial Sequence: antisense oligonucleotide
ggctaaattttgccttc

SEQ ID NO: 1333 - DNA, 17 bp, Artificial Sequence
  Description of Artificial Sequence: antisense oligonucleotide
gcaggctaaattttgcc

SEQ ID NO: 1334 - DNA, 14 bp, Artificial Sequence
  Description of Artificial Sequence: antisense oligonucleotide
gagttacccaagcg

SEQ ID NO: 1335 - DNA, 16 bp, Artificial Sequence
  Description of Artificial Sequence: antisense oligonucleotide
cagagttacccaagcg

SEQ ID NO: 1336 - DNA, 14 bp, Artificial Sequence
  Description of Artificial Sequence: antisense oligonucleotide
cagagttacccaag

SEQ ID NO: 1337 - DNA, 15 bp, Artificial Sequence
  Description of Artificial Sequence: antisense oligonucleotide
acagagttacccaag

SEQ ID NO: 1338 - DNA, 14 bp, Artificial Sequence
  Description of Artificial Sequence: antisense oligonucleotide
ggtgcaaaacagag

SEQ ID NO: 1339 - DNA, 15 bp, Artificial Sequence
  Description of Artificial Sequence: antisense oligonucleotide
ctaggtgcaaaacag

SEQ ID NO: 1340 - DNA, 18 bp, Artificial Sequence
  Description of Artificial Sequence: antisense oligonucleotide
gagaactttatcatgtcc

SEQ ID NO: 1341 - DNA, 14 bp, Artificial Sequence
  Description of Artificial Sequence: antisense oligonucleotide
gctagatgaatggc

SEQ ID NO: 1342 - DNA, 15 bp, Artificial Sequence
  Description of Artificial Sequence: antisense oligonucleotide
gcaaacatggcaggc

SEQ ID NO: 1343 - DNA, 14 bp, Artificial Sequence
  Description of Artificial Sequence: antisense oligonucleotide
cagcaaacatggca

SEQ ID NO: 1344 - DNA, 14 bp, Artificial Sequence
  Description of Artificial Sequence: antisense oligonucleotide
gcagcaaacatggc

SEQ ID NO: 1345 - DNA, 14 bp, Artificial Sequence
  Description of Artificial Sequence: antisense oligonucleotide
agcagcaaacatgg

SEQ ID NO: 1346 - DNA, 14 bp, Artificial Sequence
  Description of Artificial Sequence: antisense oligonucleotide
cagcagcaaacatg

SEQ ID NO: 1347 - DNA, 14 bp, Artificial Sequence
  Description of Artificial Sequence: antisense oligonucleotide
agcagcagcaaaca

SEQ ID NO: 1348 - DNA, 15 bp, Artificial Sequence
  Description of Artificial Sequence: antisense oligonucleotide
cagcagcagcaaaca

SEQ ID NO: 1349 - DNA, 14 bp, Artificial Sequence
  Description of Artificial Sequence: antisense oligonucleotide
cagcagcagcaaac

SEQ ID NO: 1350 - DNA, 14 bp, Artificial Sequence
  Description of Artificial Sequence: antisense oligonucleotide
caccagcagcagca

SEQ ID NO: 1351 - DNA, 14 bp, Artificial Sequence
  Description of Artificial Sequence: antisense oligonucleotide
gcattgacgtcagc

SEQ ID NO: 1352 - DNA, 15 bp, Artificial Sequence
  Description of Artificial Sequence: antisense oligonucleotide
gatgttgtcgtgctc

SEQ ID NO: 1353 - DNA, 17 bp, Artificial Sequence
  Description of Artificial Sequence: antisense oligonucleotide
tgagatgttgtcgtgct

SEQ ID NO: 1354 - DNA, 15 bp, Artificial Sequence
  Description of Artificial Sequence: antisense oligonucleotide
tgagatgttgtcgtg

SEQ ID NO: 1355 - DNA, 15 bp, Artificial Sequence
  Description of Artificial Sequence: antisense oligonucleotide
gccaatgagatgttg

SEQ ID NO: 1356 - DNA, 14 bp, Artificial Sequence
  Description of Artificial Sequence: antisense oligonucleotide
ctgccaatgagatg

SEQ ID NO: 1357 - DNA, 14 bp, Artificial Sequence
  Description of Artificial Sequence: antisense oligonucleotide
cacatgggcatcac

SEQ ID NO: 1358 - DNA, 14 bp, Artificial Sequence
  Description of Artificial Sequence: antisense oligonucleotide
tgtccacatgggca

SEQ ID NO: 1359 - DNA, 14 bp, Artificial Sequence
  Description of Artificial Sequence: antisense oligonucleotide
gtactgtccacatg

SEQ ID NO: 1360 - DNA, 14 bp, Artificial Sequence
  Description of Artificial Sequence: antisense oligonucleotide
cagctgctatatgc

SEQ ID NO: 1361 - DNA, 14 bp, Artificial Sequence
  Description of Artificial Sequence: antisense oligonucleotide
gttctccaccaggg

SEQ ID NO: 1362 - DNA, 14 bp, Artificial Sequence
  Description of Artificial Sequence: antisense oligonucleotide
agttctccaccagg

SEQ ID NO: 1363 - DNA, 16 bp, Artificial Sequence
  Description of Artificial Sequence: antisense oligonucleotide
caaagttctccaccag

SEQ ID NO: 1364 - DNA, 16 bp, Artificial Sequence
  Description of Artificial Sequence: antisense oligonucleotide
ccaagagtcatccagg

SEQ ID NO: 1365 - DNA, 14 bp, Artificial Sequence
  Description of Artificial Sequence: antisense oligonucleotide
cccaagagtcatcc

SEQ ID NO: 1366 - DNA, 16 bp, Artificial Sequence
  Description of Artificial Sequence: antisense oligonucleotide
cctgcattttcccaag

SEQ ID NO: 1367 - DNA, 14 bp, Artificial Sequence
  Description of Artificial Sequence: antisense oligonucleotide
tcctgcattttccc

SEQ ID NO: 1368 - DNA, 15 bp, Artificial Sequence
  Description of Artificial Sequence: antisense oligonucleotide
gccatatctagaggc

SEQ ID NO: 1369 - DNA, 14 bp, Artificial Sequence
  Description of Artificial Sequence: antisense oligonucleotide
tcacatcttcagcc

SEQ ID NO: 1370 - DNA, 16 bp, Artificial Sequence
  Description of Artificial Sequence: antisense oligonucleotide
gcttcacatcttcagc

SEQ ID NO: 1371 - DNA, 15 bp, Artificial Sequence
  Description of Artificial Sequence: antisense oligonucleotide
cagcttcacatcttc

SEQ ID NO: 1372 - DNA, 17 bp, Artificial Sequence
  Description of Artificial Sequence: antisense oligonucleotide
gtaacttatacagctgc

SEQ ID NO: 1373 - DNA, 15 bp, Artificial Sequence
  Description of Artificial Sequence: antisense oligonucleotide
ccagtttttgtctgg

SEQ ID NO: 1374 - DNA, 14 bp, Artificial Sequence
  Description of Artificial Sequence: antisense oligonucleotide
ccatttgtctcagg

SEQ ID NO: 1375 - DNA, 14 bp, Artificial Sequence
  Description of Artificial Sequence: antisense oligonucleotide
gtgtagcccatttg

SEQ ID NO: 1376 - DNA, 14 bp, Artificial Sequence
  Description of Artificial Sequence: antisense oligonucleotide
gcttcggtgtagcc

SEQ ID NO: 1377 - DNA, 18 bp, Artificial Sequence
  Description of Artificial Sequence: antisense oligonucleotide
gatcacttcaattgcttc

SEQ ID NO: 1378 - DNA, 14 bp, Artificial Sequence
  Description of Artificial Sequence: antisense oligonucleotide
cttgtggaggcagg

SEQ ID NO: 1379 - DNA, 14 bp, Artificial Sequence
  Description of Artificial Sequence: antisense oligonucleotide
gctgccttgtggag

SEQ ID NO: 1380 - DNA, 18 bp, Artificial Sequence
  Description of Artificial Sequence: antisense oligonucleotide
ctatttgctgccttgtgg

SEQ ID NO: 1381 - DNA, 14 bp, Artificial Sequence
  Description of Artificial Sequence: antisense oligonucleotide
ggatgtctccacgc

SEQ ID NO: 1382 - DNA, 14 bp, Artificial Sequence
  Description of Artificial Sequence: antisense oligonucleotide
ggaaggatgtctcc

SEQ ID NO: 1383 - DNA, 14 bp, Artificial Sequence
  Description of Artificial Sequence: antisense oligonucleotide
tgcggaaggatgtc

SEQ ID NO: 1384 - DNA, 17 bp, Artificial Sequence
  Description of Artificial Sequence: antisense oligonucleotide
gtttgcggaaggatgtc

SEQ ID NO: 1385 - DNA, 14 bp, Artificial Sequence
  Description of Artificial Sequence: antisense oligonucleotide
gctgagtttgcgga

SEQ ID NO: 1386 - DNA, 16 bp, Artificial Sequence
  Description of Artificial Sequence: antisense oligonucleotide
ggtaaagctgagtttg

SEQ ID NO: 1387 - DNA, 14 bp, Artificial Sequence
  Description of Artificial Sequence: antisense oligonucleotide
tcggtaaagctgag

SEQ ID NO: 1388 - DNA, 15 bp, Artificial Sequence
  Description of Artificial Sequence: antisense oligonucleotide
gactcggtaaagctg

SEQ ID NO: 1389 - DNA, 16 bp, Artificial Sequence
  Description of Artificial Sequence: antisense oligonucleotide
agagactcggtaaagc

SEQ ID NO: 1390 - DNA, 16 bp, Artificial Sequence
  Description of Artificial Sequence: antisense oligonucleotide
gaaattgtcagcaggc

SEQ ID NO: 1391 - DNA, 15 bp, Artificial Sequence
  Description of Artificial Sequence: antisense oligonucleotide
gaaattgtcagcagg

SEQ ID NO: 1392 - DNA, 16 bp, Artificial Sequence
  Description of Artificial Sequence: antisense oligonucleotide
ggaaattgtcagcagg

SEQ ID NO: 1393 - DNA, 15 bp, Artificial Sequence
  Description of Artificial Sequence: antisense oligonucleotide
ggaaattgtcagcag

SEQ ID NO: 1394 - DNA, 14 bp, Artificial Sequence
  Description of Artificial Sequence: antisense oligonucleotide
gggaaattgtcagc

SEQ ID NO: 1395 - DNA, 15 bp, Artificial Sequence
  Description of Artificial Sequence: antisense oligonucleotide
gtgtgggaaattgtc

SEQ ID NO: 1396 - DNA, 15 bp, Artificial Sequence
  Description of Artificial Sequence: antisense oligonucleotide
ggtttacacggtgtg

SEQ ID NO: 1397 - DNA, 15 bp, Artificial Sequence
  Description of Artificial Sequence: antisense oligonucleotide
gctttggtttacacg

SEQ ID NO: 1398 - DNA, 15 bp, Artificial Sequence
  Description of Artificial Sequence: antisense oligonucleotide
gcacctttgggatgc

SEQ ID NO: 1399 - DNA, 15 bp, Artificial Sequence
  Description of Artificial Sequence: antisense oligonucleotide
ccaggttctgcttcc

SEQ ID NO: 1400 - DNA, 15 bp, Artificial Sequence
  Description of Artificial Sequence: antisense oligonucleotide
gctctgtctagtggc

SEQ ID NO: 1401 - DNA, 14 bp, Artificial Sequence
  Description of Artificial Sequence: antisense oligonucleotide
actctccatgtctc

SEQ ID NO: 1402 - DNA, 16 bp, Artificial Sequence
  Description of Artificial Sequence: antisense oligonucleotide
caactctccatgtctc

SEQ ID NO: 1403 - DNA, 14 bp, Artificial Sequence
  Description of Artificial Sequence: antisense oligonucleotide
caactctccatgtc

SEQ ID NO: 1404 - DNA, 14 bp, Artificial Sequence
  Description of Artificial Sequence: antisense oligonucleotide
agcaactctccatg

SEQ ID NO: 1405 - DNA, 16 bp, Artificial Sequence
  Description of Artificial Sequence: antisense oligonucleotide
gtagcaactctccatg

SEQ ID NO: 1406 - DNA, 14 bp, Artificial Sequence
  Description of Artificial Sequence: antisense oligonucleotide
gtagcaactctcca

SEQ ID NO: 1407 - DNA, 17 bp, Artificial Sequence
  Description of Artificial Sequence: antisense oligonucleotide
ggttgtagcaactctcc

SEQ ID NO: 1408 - DNA, 14 bp, Artificial Sequence
  Description of Artificial Sequence: antisense oligonucleotide
cgggcagtcctcca

SEQ ID NO: 1409 - DNA, 13 bp, Artificial Sequence
  Description of Artificial Sequence: antisense oligonucleotide
gcaccgggcagtc

SEQ ID NO: 1410 - DNA, 13 bp, Artificial Sequence
  Description of Artificial Sequence: antisense oligonucleotide
aggcaccgggcag

SEQ ID NO: 1411 - DNA, 15 bp, Artificial Sequence
  Description of Artificial Sequence: antisense oligonucleotide
gtgtgttaccaggtc

SEQ ID NO: 1412 - DNA, 15 bp, Artificial Sequence
  Description of Artificial Sequence: antisense oligonucleotide
tgtgtgttaccaggt

SEQ ID NO: 1413 - DNA, 14 bp, Artificial Sequence
  Description of Artificial Sequence: antisense oligonucleotide
tgggtcactgtgtg

SEQ ID NO: 1414 - DNA, 15 bp, Artificial Sequence
  Description of Artificial Sequence: antisense oligonucleotide
cagactgtgggcatg

SEQ ID NO: 1415 - DNA, 16 bp, Artificial Sequence
  Description of Artificial Sequence: antisense oligonucleotide
cccaccagactgtggg

SEQ ID NO: 1416 - DNA, 14 bp, Artificial Sequence
  Description of Artificial Sequence: antisense oligonucleotide
ccaccagactgtgg

SEQ ID NO: 1417 - DNA, 14 bp, Artificial Sequence
  Description of Artificial Sequence: antisense oligonucleotide
tgcccaccagactg

SEQ ID NO: 1418 - DNA, 13 bp, Artificial Sequence
  Description of Artificial Sequence: antisense oligonucleotide
cggcttcctcccc

SEQ ID NO: 1419 - DNA, 14 bp, Artificial Sequence
  Description of Artificial Sequence: antisense oligonucleotide
ccttgtcttccacc

SEQ ID NO: 1420 - DNA, 14 bp, Artificial Sequence
  Description of Artificial Sequence: antisense oligonucleotide
accgaggctgccac

SEQ ID NO: 1421 - DNA, 14 bp, Artificial Sequence
  Description of Artificial Sequence: antisense oligonucleotide
ggaagaaaccgagg

SEQ ID NO: 1422 - DNA, 14 bp, Artificial Sequence
  Description of Artificial Sequence: antisense oligonucleotide
gggaagaaaccgag

SEQ ID NO: 1423 - DNA, 13 bp, Artificial Sequence
  Description of Artificial Sequence: antisense oligonucleotide
ggccatctgcgcc

SEQ ID NO: 1424 - DNA, 13 bp, Artificial Sequence
  Description of Artificial Sequence: antisense oligonucleotide
gcggccatctgcg

SEQ ID NO: 1425 - DNA, 14 bp, Artificial Sequence
  Description of Artificial Sequence: antisense oligonucleotide
gtggcggccatctg

SEQ ID NO: 1426 - DNA, 14 bp, Artificial Sequence
  Description of Artificial Sequence: antisense oligonucleotide
accgtggcggccat

SEQ ID NO: 1427 - DNA, 17 bp, Artificial Sequence
  Description of Artificial Sequence: antisense oligonucleotide
gccgctcaatcttcatc

SEQ ID NO: 1428 - DNA, 17 bp, Artificial Sequence
  Description of Artificial Sequence: antisense oligonucleotide
cttcatcttgtgatagg

SEQ ID NO: 1429 - DNA, 17 bp, Artificial Sequence
  Description of Artificial Sequence: antisense oligonucleotide
gctcaatcttcatcttg

SEQ ID NO: 1430 - DNA, 17 bp, Artificial Sequence
  Description of Artificial Sequence: antisense oligonucleotide
cagaaacactgttacag

SEQ ID NO: 1431 - DNA, 17 bp, Artificial Sequence
  Description of Artificial Sequence: antisense oligonucleotide
cagttgcagaaacactg

SEQ ID NO: 1432 - DNA, 17 bp, Artificial Sequence
  Description of Artificial Sequence: antisense oligonucleotide
gtttcagttgcagaaac

SEQ ID NO: 1433 - DNA, 14 bp, Artificial Sequence
  Description of Artificial Sequence: antisense oligonucleotide
cttccaccagaggg

SEQ ID NO: 1434 - DNA, 14 bp, Artificial Sequence
  Description of Artificial Sequence: antisense oligonucleotide
gtcttccaccagag

SEQ ID NO: 1435 - DNA, 17 bp, Artificial Sequence
  Description of Artificial Sequence: antisense oligonucleotide
cttgtcttccaccagag

SEQ ID NO: 1436 - DNA, 14 bp, Artificial Sequence
  Description of Artificial Sequence: antisense oligonucleotide
tccttgtcttccac

SEQ ID NO: 1437 - DNA, 16 bp, Artificial Sequence
  Description of Artificial Sequence: antisense oligonucleotide
cttccttgtcttccac

SEQ ID NO: 1438 - DNA, 15 bp, Artificial Sequence
  Description of Artificial Sequence: antisense oligonucleotide
catcttgtgataggg

SEQ ID NO: 1439 - DNA, 15 bp, Artificial Sequence
  Description of Artificial Sequence: antisense oligonucleotide
gctaggtgcagtggt

SEQ ID NO: 1440 - DNA, 14 bp, Artificial Sequence
  Description of Artificial Sequence: antisense oligonucleotide
gatggctaggtgca

SEQ ID NO: 1441 - DNA, 15 bp, Artificial Sequence
  Description of Artificial Sequence: antisense oligonucleotide
gtggatgatggctag

SEQ ID NO: 1442 - DNA, 14 bp, Artificial Sequence
  Description of Artificial Sequence: antisense oligonucleotide
cccgtggatgatgg

SEQ ID NO: 1443 - DNA, 14 bp, Artificial Sequence
  Description of Artificial Sequence: antisense oligonucleotide
ctgcccgtggatga

SEQ ID NO: 1444 - DNA, 14 bp, Artificial Sequence
  Description of Artificial Sequence: antisense oligonucleotide
agagcctccaccca

SEQ ID NO: 1445 - DNA, 15 bp, Artificial Sequence
  Description of Artificial Sequence: antisense oligonucleotide
gttgtactctcgagc

SEQ ID NO: 1446 - DNA, 13 bp, Artificial Sequence
  Description of Artificial Sequence: antisense oligonucleotide
cgttgtactctcg

SEQ ID NO: 1447 - DNA, 14 bp, Artificial Sequence
  Description of Artificial Sequence: antisense oligonucleotide
cgcgttgtactctc

SEQ ID NO: 1448 - DNA, 14 bp, Artificial Sequence
  Description of Artificial Sequence: antisense oligonucleotide
gagtctccatgccg

SEQ ID NO: 1449 - DNA, 14 bp, Artificial Sequence
  Description of Artificial Sequence: antisense oligonucleotide
ctgagtctccatgc

SEQ ID NO: 1450 - DNA, 14 bp, Artificial Sequence
  Description of Artificial Sequence: antisense oligonucleotide
catggctgagtctc

SEQ ID NO: 1451 - DNA, 14 bp, Artificial Sequence
  Description of Artificial Sequence: antisense oligonucleotide
tgcatggctgagtc

SEQ ID NO: 1452 - DNA, 14 bp, Artificial Sequence
  Description of Artificial Sequence: antisense oligonucleotide
gcgttcacgttggc

SEQ ID NO: 1453 - DNA, 14 bp, Artificial Sequence
  Description of Artificial Sequence: antisense oligonucleotide
gtgcgagcgttcac

SEQ ID NO: 1454 - DNA, 14 bp, Artificial Sequence
  Description of Artificial Sequence: antisense oligonucleotide
aggtgcgagcgttc

SEQ ID NO: 1455 - DNA, 14 bp, Artificial Sequence
  Description of Artificial Sequence: antisense oligonucleotide
gcaaaggtgcgagc

SEQ ID NO: 1456 - DNA, 14 bp, Artificial Sequence
  Description of Artificial Sequence: antisense oligonucleotide
cctggtggctcagg

SEQ ID NO: 1457 - DNA, 14 bp, Artificial Sequence
  Description of Artificial Sequence: antisense oligonucleotide
gtcagtcacctgag

SEQ ID NO: 1458 - DNA, 15 bp, Artificial Sequence
  Description of Artificial Sequence: antisense oligonucleotide
caggtcagtcacctg

SEQ ID NO: 1459 - DNA, 15 bp, Artificial Sequence
  Description of Artificial Sequence: antisense oligonucleotide
cagcaggtcagtcac

SEQ ID NO: 1460 - DNA, 14 bp, Artificial Sequence
  Description of Artificial Sequence: antisense oligonucleotide
gcagcaggtcagtc

SEQ ID NO: 1461 - DNA, 17 bp, Artificial Sequence
  Description of Artificial Sequence: antisense oligonucleotide
catttagcagcaaggtc

SEQ ID NO: 1462 - DNA, 15 bp, Artificial Sequence
  Description of Artificial Sequence: antisense oligonucleotide
gcagcatttagcagc

SEQ ID NO: 1463 - DNA, 14 bp, Artificial Sequence
  Description of Artificial Sequence: antisense oligonucleotide
ctgagcagcatttg

SEQ ID NO: 1464 - DNA, 14 bp, Artificial Sequence
  Description of Artificial Sequence: antisense oligonucleotide
cccatgagaatcct

SEQ ID NO: 1465 - DNA, 17 bp, Artificial Sequence
  Description of Artificial Sequence: antisense oligonucleotide
ccttcccatgagaatcc

SEQ ID NO: 1466 - DNA, 14 bp, Artificial Sequence
  Description of Artificial Sequence: antisense oligonucleotide
tcctccccttccca

SEQ ID NO: 1467 - DNA, 14 bp, Artificial Sequence
  Description of Artificial Sequence: antisense oligonucleotide
gcctccagtagacc

SEQ ID NO: 1468 - DNA, 14 bp, Artificial Sequence
  Description of Artificial Sequence: antisense oligonucleotide
gtcagacagggcct

SEQ ID NO: 1469 - DNA, 14 bp, Artificial Sequence
  Description of Artificial Sequence: antisense oligonucleotide
ccatgtcagacagg

SEQ ID NO: 1470 - DNA, 14 bp, Artificial Sequence
  Description of Artificial Sequence: antisense oligonucleotide
ggcccatgtcagac

SEQ ID NO: 1471 - DNA, 17 bp, Artificial Sequence
  Description of Artificial Sequence: antisense oligonucleotide
gctattcctgaaatcac

SEQ ID NO: 1472 - DNA, 17 bp, Artificial Sequence
  Description of Artificial Sequence: antisense oligonucleotide
cctcttgtcttcttacc

SEQ ID NO: 1473 - DNA, 17 bp, Artificial Sequence
  Description of Artificial Sequence: antisense oligonucleotide
ggagaagaaacctcttg

SEQ ID NO: 1474 - DNA, 17 bp, Artificial Sequence
  Description of Artificial Sequence: antisense oligonucleotide
ccttgctgaagtttctt

SEQ ID NO: 1475 - DNA, 14 bp, Artificial Sequence
  Description of Artificial Sequence: antisense oligonucleotide
ccaagactccttgc

SEQ ID NO: 1476 - DNA, 14 bp, Artificial Sequence
  Description of Artificial Sequence: antisense oligonucleotide
ccctttcatggagc

SEQ ID NO: 1477 - DNA, 14 bp, Artificial Sequence
  Description of Artificial Sequence: antisense oligonucleotide
cctcttggtgtgac

SEQ ID NO: 1478 - DNA, 14 bp, Artificial Sequence
  Description of Artificial Sequence: antisense oligonucleotide
gactaaggatgccg

SEQ ID NO: 1479 - DNA, 15 bp, Artificial Sequence
  Description of Artificial Sequence: antisense oligonucleotide
gtggcaggactaagg

SEQ ID NO: 1480 - DNA, 14 bp, Artificial Sequence
  Description of Artificial Sequence: antisense oligonucleotide
agacgtggcaggac

SEQ ID NO: 1481 - DNA, 14 bp, Artificial Sequence
  Description of Artificial Sequence: antisense oligonucleotide
cttccagcaggcag

SEQ ID NO: 1482 - DNA, 14 bp, Artificial Sequence
  Description of Artificial Sequence: antisense oligonucleotide
gttcctctgcctgg

SEQ ID NO: 1483 - DNA, 16 bp, Artificial Sequence
  Description of Artificial Sequence: antisense oligonucleotide
gatgttcctctgcctg

SEQ ID NO: 1484 - DNA, 16 bp, Artificial Sequence
  Description of Artificial Sequence: antisense oligonucleotide
gagatgttcctctgcc

SEQ ID NO: 1485 - DNA, 16 bp, Artificial Sequence
  Description of Artificial Sequence: antisense oligonucleotide
gtgagatgttcctctg

SEQ ID NO: 1486 - DNA, 18 bp, Artificial Sequence
  Description of Artificial Sequence: antisense oligonucleotide
cagagagtgagatgttcc

SEQ ID NO: 1487 - DNA, 18 bp, Artificial Sequence
  Description of Artificial Sequence: antisense oligonucleotide
ccagagagtgagatgttc

SEQ ID NO: 1488 - DNA, 15 bp, Artificial Sequence
  Description of Artificial Sequence: antisense oligonucleotide
ggtccagagagtgag

SEQ ID NO: 1489 - DNA, 15 bp, Artificial Sequence
  Description of Artificial Sequence: antisense oligonucleotide
gaggtccagagagtg

SEQ ID NO: 1490 - DNA, 14 bp, Artificial Sequence
  Description of Artificial Sequence: antisense oligonucleotide
ggtcctgtagtgcc

SEQ ID NO: 1491 - DNA, 17 bp, Artificial Sequence
  Description of Artificial Sequence: antisense oligonucleotide
gattttatgatgcaggc

SEQ ID NO: 1492 - DNA, 18 bp, Artificial Sequence
  Description of Artificial Sequence: antisense oligonucleotide
gacctgcatcccttattg

SEQ ID NO: 1493 - DNA, 18 bp, Artificial Sequence
  Description of Artificial Sequence: antisense oligonucleotide
tagttgattttccagcag

SEQ ID NO: 1494 - DNA, 16 bp, Artificial Sequence
  Description of Artificial Sequence: antisense oligonucleotide
gaatctcacgttttgc

SEQ ID NO: 1495 - DNA, 18 bp, Artificial Sequence
  Description of Artificial Sequence: antisense oligonucleotide
cagagaaagaatctcacg

SEQ ID NO: 1496 - DNA, 18 bp, Artificial Sequence
  Description of Artificial Sequence: antisense oligonucleotide
tttcaccatcagagaaag

SEQ ID NO: 1497 - DNA, 17 bp, Artificial Sequence
  Description of Artificial Sequence: antisense oligonucleotide
catttggacatttcacc

SEQ ID NO: 1498 - DNA, 18 bp, Artificial Sequence
  Description of Artificial Sequence: antisense oligonucleotide
ccttcatttggacatttc

SEQ ID NO: 1499 - DNA, 18 bp, Artificial Sequence
  Description of Artificial Sequence: antisense oligonucleotide
caatgtgcttgatgatcc

SEQ ID NO: 1500 - DNA, 15 bp, Artificial Sequence
  Description of Artificial Sequence: antisense oligonucleotide
cgcatcggatttctc

SEQ ID NO: 1501 - DNA, 18 bp, Artificial Sequence
  Description of Artificial Sequence: antisense oligonucleotide
caaaccgcatcggatttc

SEQ ID NO: 1502 - DNA, 14 bp, Artificial Sequence
  Description of Artificial Sequence: antisense oligonucleotide
gaactgcaaaccgc

SEQ ID NO: 1503 - DNA, 15 bp, Artificial Sequence
  Description of Artificial Sequence: antisense oligonucleotide
gcagagaagaactgc

SEQ ID NO: 1504 - DNA, 15 bp, Artificial Sequence
  Description of Artificial Sequence: antisense oligonucleotide
gcaagtaaacatggg

SEQ ID NO: 1505 - DNA, 14 bp, Artificial Sequence
  Description of Artificial Sequence: antisense oligonucleotide
ggtccacgttttgg

SEQ ID NO: 1506 - DNA, 16 bp, Artificial Sequence
  Description of Artificial Sequence: antisense oligonucleotide
gcaagggtccacgttt

SEQ ID NO: 1507 - DNA, 17 bp, Artificial Sequence
  Description of Artificial Sequence: antisense oligonucleotide
tggcttcttcttcaggg

SEQ ID NO: 1508 - DNA, 16 bp, Artificial Sequence
  Description of Artificial Sequence: antisense oligonucleotide
tcctgctggcttcttc

SEQ ID NO: 1509 - DNA, 14 bp, Artificial Sequence
  Description of Artificial Sequence: antisense oligonucleotide
gtcctgctggcttc

SEQ ID NO: 1510 - DNA, 17 bp, Artificial Sequence
  Description of Artificial Sequence: antisense oligonucleotide
ggtagtctaggaattgg

SEQ ID NO: 1511 - DNA, 17 bp, Artificial Sequence
  Description of Artificial Sequence: antisense oligonucleotide
cttgcaggtagtctagg

SEQ ID NO: 1512 - DNA, 17 bp, Artificial Sequence
  Description of Artificial Sequence: antisense oligonucleotide
gaaactcttgcaggtag

SEQ ID NO: 1513 - DNA, 17 bp, Artificial Sequence
  Description of Artificial Sequence: antisense oligonucleotide
caccaagaaactcttgc

SEQ ID NO: 1514 - DNA, 18 bp, Artificial Sequence
  Description of Artificial Sequence: antisense oligonucleotide
cattacaccaagaaactc

SEQ ID NO: 1515 - DNA, 18 bp, Artificial Sequence
  Description of Artificial Sequence: antisense oligonucleotide
ctcggtgttcattacacc

SEQ ID NO: 1516 - DNA, 18 bp, Artificial Sequence
  Description of Artificial Sequence: antisense oligonucleotide
ctttctattatccactcg

SEQ ID NO: 1517 - DNA, 18 bp, Artificial Sequence
  Description of Artificial Sequence: antisense oligonucleotide
ccagtttagtctcaactt

SEQ ID NO: 1518 - DNA, 18 bp, Artificial Sequence
  Description of Artificial Sequence: antisense oligonucleotide
aaccagtttagtctcaac

SEQ ID NO: 1519 - DNA, 18 bp, Artificial Sequence
  Description of Artificial Sequence: antisense oligonucleotide
acaaaccagtttagtctc

SEQ ID NO: 1520 - DNA, 18 bp, Artificial Sequence
  Description of Artificial Sequence: antisense oligonucleotide
ctcgcgaaaaagtttctt

SEQ ID NO: 1521 - DNA, 18 bp, Artificial Sequence
  Description of Artificial Sequence: antisense oligonucleotide
ccctcgcgaaaaagtttc

SEQ ID NO: 1522 - DNA, 16 bp, Artificial Sequence
  Description of Artificial Sequence: antisense oligonucleotide
gtccctcgcgaaaaag

SEQ ID NO: 1523 - DNA, 15 bp, Artificial Sequence
  Description of Artificial Sequence: antisense oligonucleotide
cagttgaaccgtccc

SEQ ID NO: 1524 - DNA, 18 bp, Artificial Sequence
  Description of Artificial Sequence: antisense oligonucleotide
gctttcgaagtttcagtt

SEQ ID NO: 1525 - DNA, 17 bp, Artificial Sequence
  Description of Artificial Sequence: antisense oligonucleotide
gatgctttcgaagtttc

SEQ ID NO: 1526 - DNA, 18 bp, Artificial Sequence
  Description of Artificial Sequence: antisense oligonucleotide
ctgtctctgcaaataatg

SEQ ID NO: 1527 - DNA, 18 bp, Artificial Sequence
  Description of Artificial Sequence: antisense oligonucleotide
cacttattacattcaccc

SEQ ID NO: 1528 - DNA, 17 bp, Artificial Sequence
  Description of Artificial Sequence: antisense oligonucleotide
ttttcctccagttcctc

SEQ ID NO: 1529 - DNA, 20 bp, Artificial Sequence
  Description of Artificial Sequence: antisense oligonucleotide
ggacaatatgtacaaaactc

SEQ ID NO: 1530 - DNA, 18 bp, Artificial Sequence
  Description of Artificial Sequence: antisense oligonucleotide
gttgatgaacatttggac

SEQ ID NO: 1531 - DNA, 18 bp, Artificial Sequence
  Description of Artificial Sequence: antisense oligonucleotide
gtgttgatgaacatttgg

SEQ ID NO: 1532 - DNA, 16 bp, Artificial Sequence
  Description of Artificial Sequence: antisense oligonucleotide
caaaatttggccaggg

SEQ ID NO: 1533 - DNA, 15 bp, Artificial Sequence
  Description of Artificial Sequence: antisense oligonucleotide
gcccaaaatttggcc

SEQ ID NO: 1534 - DNA, 17 bp, Artificial Sequence
  Description of Artificial Sequence: antisense oligonucleotide
cccagcccaaaatttgg

SEQ ID NO: 1535 - DNA, 17 bp, Artificial Sequence
  Description of Artificial Sequence: antisense oligonucleotide
gtccccagcccaaaatt

SEQ ID NO: 1536 - DNA, 16 bp, Artificial Sequence
  Description of Artificial Sequence: antisense oligonucleotide
aaatcgccagaggctg

SEQ ID NO: 1537 - DNA, 16 bp, Artificial Sequence
  Description of Artificial Sequence: antisense oligonucleotide
accaaatcgccagagg

SEQ ID NO: 1538 - DNA, 17 bp, Artificial Sequence
  Description of Artificial Sequence: antisense oligonucleotide
catcaccaaatcgccag

SEQ ID NO: 1539 - DNA, 16 bp, Artificial Sequence
  Description of Artificial Sequence: antisense oligonucleotide
taggagtggttgaggc

SEQ ID NO: 1540 - DNA, 17 bp, Artificial Sequence
  Description of Artificial Sequence: antisense oligonucleotide
gtgtaggagtggttgag

SEQ ID NO: 1541 - DNA, 14 bp, Artificial Sequence
  Description of Artificial Sequence: antisense oligonucleotide
ctgtgtaggagtgg

SEQ ID NO: 1542 - DNA, 14 bp, Artificial Sequence
  Description of Artificial Sequence: antisense oligonucleotide
cccacatgcctgtg

SEQ ID NO: 1543 - DNA, 14 bp, Artificial Sequence
  Description of Artificial Sequence: antisense oligonucleotide
cgatgaacaacgag

SEQ ID NO: 1544 - DNA, 16 bp, Artificial Sequence
  Description of Artificial Sequence: antisense oligonucleotide
ctggcgatgaacaacg

SEQ ID NO: 1545 - DNA, 14 bp, Artificial Sequence
  Description of Artificial Sequence: antisense oligonucleotide
cgctggcgatgaac

SEQ ID NO: 1546 - DNA, 15 bp, Artificial Sequence
  Description of Artificial Sequence: antisense oligonucleotide
gagctagtcccgttg

SEQ ID NO: 1547 - DNA, 15 bp, Artificial Sequence
  Description of Artificial Sequence: antisense oligonucleotide
gcgaagagctagtcc

SEQ ID NO: 1548 - DNA, 17 bp, Artificial Sequence
  Description of Artificial Sequence: antisense oligonucleotide
ccagttatgcgaagagc

SEQ ID NO: 1549 - DNA, 16 bp, Artificial Sequence
  Description of Artificial Sequence: antisense oligonucleotide
ccccagttatgcgaag

SEQ ID NO: 1550 - DNA, 14 bp, Artificial Sequence
  Description of Artificial Sequence: antisense oligonucleotide
cacatgcttggcgc

SEQ ID NO: 1551 - DNA, 16 bp, Artificial Sequence
  Description of Artificial Sequence: antisense oligonucleotide
gatcacatgcttggcg

SEQ ID NO: 1552 - DNA, 18 bp, Artificial Sequence
  Description of Artificial Sequence: antisense oligonucleotide
gacaaagagcatgatcac

SEQ ID NO: 1553 - DNA, 17 bp, Artificial Sequence
  Description of Artificial Sequence: antisense oligonucleotide
gagtcacagggacaaag

SEQ ID NO: 1554 - DNA, 15 bp, Artificial Sequence
  Description of Artificial Sequence: antisense oligonucleotide
gagagtcacagggac

SEQ ID NO: 1555 - DNA, 15 bp, Artificial Sequence
  Description of Artificial Sequence: antisense oligonucleotide
gcagagagtcacagg

SEQ ID NO: 1556 - DNA, 14 bp, Artificial Sequence
  Description of Artificial Sequence: antisense oligonucleotide
ccatgcagagagtc

SEQ ID NO: 1557 - DNA, 15 bp, Artificial Sequence
  Description of Artificial Sequence: antisense oligonucleotide
ccaccatgcagagag

SEQ ID NO: 1558 - DNA, 14 bp, Artificial Sequence
  Description of Artificial Sequence: antisense oligonucleotide
tagccacgaccacc

SEQ ID NO: 1559 - DNA, 18 bp, Artificial Sequence
  Description of Artificial Sequence: antisense oligonucleotide
gattagctgcccatcctt

SEQ ID NO: 1560 - DNA, 17 bp, Artificial Sequence
  Description of Artificial Sequence: antisense oligonucleotide
ggtatagattagctgcc

SEQ ID NO: 1561 - DNA, 18 bp, Artificial Sequence
  Description of Artificial Sequence: antisense oligonucleotide
gtatcttctgtgaatggg

SEQ ID NO: 1562 - DNA, 14 bp, Artificial Sequence
  Description of Artificial Sequence: antisense oligonucleotide
ctggcccacagtct

SEQ ID NO: 1563 - DNA, 14 bp, Artificial Sequence
  Description of Artificial Sequence: antisense oligonucleotide
ctctggcccacagt

SEQ ID NO: 1564 - DNA, 14 bp, Artificial Sequence
  Description of Artificial Sequence: antisense oligonucleotide
tgcagggctctctg

SEQ ID NO: 1565 - DNA, 14 bp, Artificial Sequence
  Description of Artificial Sequence: antisense oligonucleotide
agtgcagggctctc

SEQ ID NO: 1566 - DNA, 16 bp, Artificial Sequence
  Description of Artificial Sequence: antisense oligonucleotide
cactgatcatgatggc

SEQ ID NO: 1567 - DNA, 18 bp, Artificial Sequence
  Description of Artificial Sequence: antisense oligonucleotide
gacactgatcatgatggc

SEQ ID NO: 1568 - DNA, 18 bp, Artificial Sequence
  Description of Artificial Sequence: antisense oligonucleotide
acaatgacactgatcatg

SEQ ID NO: 1569 - DNA, 16 bp, Artificial Sequence
  Description of Artificial Sequence: antisense oligonucleotide
gaaccaccaggaggat

SEQ ID NO: 1570 - DNA, 17 bp, Artificial Sequence
  Description of Artificial Sequence: antisense oligonucleotide
gacacaaaacagccact

SEQ ID NO: 1571 - DNA, 15 bp, Artificial Sequence
  Description of Artificial Sequence: antisense oligonucleotide
gtggacctttcggac

SEQ ID NO: 1572 - DNA, 17 bp, Artificial Sequence
  Description of Artificial Sequence: antisense oligonucleotide
caaccagcatacgaagt

SEQ ID NO: 1573 - DNA, 14 bp, Artificial Sequence
  Description of Artificial Sequence: antisense oligonucleotide
tccctctgggcttc

SEQ ID NO: 1574 - DNA, 14 bp, Artificial Sequence
  Description of Artificial Sequence: antisense oligonucleotide
actgtccctctggg

SEQ ID NO: 1575 - DNA, 14 bp, Artificial Sequence
  Description of Artificial Sequence: antisense oligonucleotide
gactgtccctctgg

SEQ ID NO: 1576 - DNA, 16 bp, Artificial Sequence
  Description of Artificial Sequence: antisense oligonucleotide
cctagatgactgtccc

SEQ ID NO: 1577 - DNA, 15 bp, Artificial Sequence
  Description of Artificial Sequence: antisense oligonucleotide
cagcgaggatactgc

SEQ ID NO: 1578 - DNA, 16 bp, Artificial Sequence
  Description of Artificial Sequence: antisense oligonucleotide
cttcaccagcgaggat

SEQ ID NO: 1579 - DNA, 18 bp, Artificial Sequence
  Description of Artificial Sequence: antisense oligonucleotide
tttcctctgggtcttcac

SEQ ID NO: 1580 - DNA, 17 bp, Artificial Sequence
  Description of Artificial Sequence: antisense oligonucleotide
ctttcctctgggtcttc

SEQ ID NO: 1581 - DNA, 17 bp, Artificial Sequence
  Description of Artificial Sequence: antisense oligonucleotide
ctcccaatccaagtttt

SEQ ID NO: 1582 - DNA, 14 bp, Artificial Sequence
  Description of Artificial Sequence: antisense oligonucleotide
ttcatcccggagcc

SEQ ID NO: 1583 - DNA, 16 bp, Artificial Sequence
  Description of Artificial Sequence: antisense oligonucleotide
ttcttcatcccggagc

SEQ ID NO: 1584 - DNA, 16 bp, Artificial Sequence
  Description of Artificial Sequence: antisense oligonucleotide
gctcagccagttcttc

SEQ ID NO: 1585 - DNA, 14 bp, Artificial Sequence
  Description of Artificial Sequence: antisense oligonucleotide
gacagagagggcac

SEQ ID NO: 1586 - DNA, 15 bp, Artificial Sequence
  Description of Artificial Sequence: antisense oligonucleotide
cttcacctccgacag

SEQ ID NO: 1587 - DNA, 16 bp, Artificial Sequence
  Description of Artificial Sequence: antisense oligonucleotide
gaaaagtctgggcagg

SEQ ID NO: 1588 - DNA, 18 bp, Artificial Sequence
  Description of Artificial Sequence: antisense oligonucleotide
gaccctggaacagaaaag

SEQ ID NO: 1589 - DNA, 15 bp, Artificial Sequence
  Description of Artificial Sequence: antisense oligonucleotide
ctgaccctggaacag

SEQ ID NO: 1590 - DNA, 16 bp, Artificial Sequence
  Description of Artificial Sequence: antisense oligonucleotide
actacaggctgaccct

SEQ ID NO: 1591 - DNA, 18 bp, Artificial Sequence
  Description of Artificial Sequence: antisense oligonucleotide
attcactacaggctgacc

SEQ ID NO: 1592 - DNA, 14 bp, Artificial Sequence
  Description of Artificial Sequence: antisense oligonucleotide
cgattcactacagg

SEQ ID NO: 1593 - DNA, 14 bp, Artificial Sequence
  Description of Artificial Sequence: antisense oligonucleotide
ggccgattcactac

SEQ ID NO: 1594 - DNA, 16 bp, Artificial Sequence
  Description of Artificial Sequence: antisense oligonucleotide
cgaacgtctgttggtc

SEQ ID NO: 1595 - DNA, 15 bp, Artificial Sequence
  Description of Artificial Sequence: antisense oligonucleotide
cgcgaacgtctgttg

SEQ ID NO: 1596 - DNA, 18 bp, Artificial Sequence
  Description of Artificial Sequence: antisense oligonucleotide
cttctgtttgtcgaggat

SEQ ID NO: 1597 - DNA, 18 bp, Artificial Sequence
  Description of Artificial Sequence: antisense oligonucleotide
ttcaccaccttctgtttg

SEQ ID NO: 1598 - DNA, 18 bp, Artificial Sequence
  Description of Artificial Sequence: antisense oligonucleotide
aggatgcgcttttcattc

SEQ ID NO: 1599 - DNA, 15 bp, Artificial Sequence
  Description of Artificial Sequence: antisense oligonucleotide
agcttgcaggatgcg

SEQ ID NO: 1600 - DNA, 18 bp, Artificial Sequence
  Description of Artificial Sequence: antisense oligonucleotide
gttgacagcttgcaggat

SEQ ID NO: 1601 - DNA, 18 bp, Artificial Sequence
  Description of Artificial Sequence: antisense oligonucleotide
ggaacggaaagttgacag

SEQ ID NO: 1602 - DNA, 18 bp, Artificial Sequence
  Description of Artificial Sequence: antisense oligonucleotide
aactcgagtttgacgagg

SEQ ID NO: 1603 - DNA, 17 bp, Artificial Sequence
  Description of Artificial Sequence: antisense oligonucleotide
tgtccttgaaggagaac

SEQ ID NO: 1604 - DNA, 18 bp, Artificial Sequence
  Description of Artificial Sequence: antisense oligonucleotide
cgtactccatgaccatgt

SEQ ID NO: 1605 - DNA, 16 bp, Artificial Sequence
  Description of Artificial Sequence: antisense oligonucleotide
gcacgtactccatgac

SEQ ID NO: 1606 - DNA, 16 bp, Artificial Sequence
  Description of Artificial Sequence: antisense oligonucleotide
gattctccggcttcag

SEQ ID NO: 1607 - DNA, 18 bp, Artificial Sequence
  Description of Artificial Sequence: antisense oligonucleotide
tcaatgagcagattctcc

SEQ ID NO: 1608 - DNA, 17 bp, Artificial Sequence
  Description of Artificial Sequence: antisense oligonucleotide
ggtcaatgagcagattc

SEQ ID NO: 1609 - DNA, 15 bp, Artificial Sequence
  Description of Artificial Sequence: antisense oligonucleotide
ccctgctggtcaatg

SEQ ID NO: 1610 - DNA, 14 bp, Artificial Sequence
  Description of Artificial Sequence: antisense oligonucleotide
tagccctgctggtc

SEQ ID NO: 1611 - DNA, 14 bp, Artificial Sequence
  Description of Artificial Sequence: antisense oligonucleotide
cgcttggcgaaacc

SEQ ID NO: 1612 - DNA, 14 bp, Artificial Sequence
  Description of Artificial Sequence: antisense oligonucleotide
ccttcacgcgcttg

SEQ ID NO: 1613 - DNA, 14 bp, Artificial Sequence
  Description of Artificial Sequence: antisense oligonucleotide
aaggtccaagtgcg

SEQ ID NO: 1614 - DNA, 14 bp, Artificial Sequence
  Description of Artificial Sequence: antisense oligonucleotide
tgccgcacaaggtc

SEQ ID NO: 1615 - DNA, 17 bp, Artificial Sequence
  Description of Artificial Sequence: antisense oligonucleotide
ggtgaggaccaccattt

SEQ ID NO: 1616 - DNA, 14 bp, Artificial Sequence
  Description of Artificial Sequence: antisense oligonucleotide
gggtgtcacaggtg

SEQ ID NO: 1617 - DNA, 18 bp, Artificial Sequence
  Description of Artificial Sequence: antisense oligonucleotide
ataccatcttcttcaggg

SEQ ID NO: 1618 - DNA, 18 bp, Artificial Sequence
  Description of Artificial Sequence: antisense oligonucleotide
ggtgataccatcttcttc

SEQ ID NO: 1619 - DNA, 18 bp, Artificial Sequence
  Description of Artificial Sequence: antisense oligonucleotide
ccaggtgataccatcttc

SEQ ID NO: 1620 - DNA, 15 bp, Artificial Sequence
  Description of Artificial Sequence: antisense oligonucleotide
cctcactgctctggt

SEQ ID NO: 1621 - DNA, 14 bp, Artificial Sequence
  Description of Artificial Sequence: antisense oligonucleotide
taagacctcactgc

SEQ ID NO: 1622 - DNA, 16 bp, Artificial Sequence
  Description of Artificial Sequence: antisense oligonucleotide
cagagcctaagacctc

SEQ ID NO: 1623 - DNA, 15 bp, Artificial Sequence
  Description of Artificial Sequence: antisense oligonucleotide
ccagagcctaagacc

SEQ ID NO: 1624 - DNA, 18 bp, Artificial Sequence
  Description of Artificial Sequence: antisense oligonucleotide
tcttcctttttgtgaagc

SEQ ID NO: 1625 - DNA, 18 bp, Artificial Sequence
  Description of Artificial Sequence: antisense oligonucleotide
gaccaaattccatcttcc

SEQ ID NO: 1626 - DNA, 18 bp, Artificial Sequence
  Description of Artificial Sequence: antisense oligonucleotide
atcagtggaccaaattcc

SEQ ID NO: 1627 - DNA, 18 bp, Artificial Sequence
  Description of Artificial Sequence: antisense oligonucleotide
ggttctttctggtccttt

SEQ ID NO: 1628 - DNA, 18 bp, Artificial Sequence
  Description of Artificial Sequence: antisense oligonucleotide
tttttgggttctttctgg

SEQ ID NO: 1629 - DNA, 18 bp, Artificial Sequence
  Description of Artificial Sequence: antisense oligonucleotide
ggtcttatttttgggttc

SEQ ID NO: 1630 - DNA, 17 bp, Artificial Sequence
  Description of Artificial Sequence: antisense oligonucleotide
aatgggcagactctcct

SEQ ID NO: 1631 - DNA, 18 bp, Artificial Sequence
  Description of Artificial Sequence: antisense oligonucleotide
tccaccatgacctcaatg

SEQ ID NO: 1632 - DNA, 16 bp, Artificial Sequence
  Description of Artificial Sequence: antisense oligonucleotide
aacggcatccaccatg

SEQ ID NO: 1633 - DNA, 15 bp, Artificial Sequence
  Description of Artificial Sequence: antisense oligonucleotide
gtgaacggcatccac

SEQ ID NO: 1634 - DNA, 18 bp, Artificial Sequence
  Description of Artificial Sequence: antisense oligonucleotide
acttgagcttgtgaacgg

SEQ ID NO: 1635 - DNA, 18 bp, Artificial Sequence
  Description of Artificial Sequence: antisense oligonucleotide
ttcatacttgagcttgtg

SEQ ID NO: 1636 - DNA, 18 bp, Artificial Sequence
  Description of Artificial Sequence: antisense oligonucleotide
ctggtgtagttttcatac

SEQ ID NO: 1637 - DNA, 18 bp, Artificial Sequence
  Description of Artificial Sequence: antisense oligonucleotide
agctgctggtgtagtttt

SEQ ID NO: 1638 - DNA, 14 bp, Artificial Sequence
  Description of Artificial Sequence: antisense oligonucleotide
aggaggaccagggt

SEQ ID NO: 1639 - DNA, 14 bp, Artificial Sequence
  Description of Artificial Sequence: antisense oligonucleotide
aggtggtccaggag

SEQ ID NO: 1640 - DNA, 18 bp, Artificial Sequence
  Description of Artificial Sequence: antisense oligonucleotide
tttctggccaaactgagg

SEQ ID NO: 1641 - DNA, 14 bp, Artificial Sequence
  Description of Artificial Sequence: antisense oligonucleotide
ggaggtttctggcc

SEQ ID NO: 1642 - DNA, 14 bp, Artificial Sequence
  Description of Artificial Sequence: antisense oligonucleotide
tctggagtggccac

SEQ ID NO: 1643 - DNA, 18 bp, Artificial Sequence
  Description of Artificial Sequence: antisense oligonucleotide
cttctggagcatgttgct

SEQ ID NO: 1644 - DNA, 15 bp, Artificial Sequence
  Description of Artificial Sequence: antisense oligonucleotide
gccttctggagcatg

SEQ ID NO: 1645 - DNA, 17 bp, Artificial Sequence
  Description of Artificial Sequence: antisense oligonucleotide
gtttgtctggccttctg

SEQ ID NO: 1646 - DNA, 18 bp, Artificial Sequence
  Description of Artificial Sequence: antisense oligonucleotide
gagtttgtctggccttct

SEQ ID NO: 1647 - DNA, 18 bp, Artificial Sequence
  Description of Artificial Sequence: antisense oligonucleotide
ctagagtttgtctggcct

SEQ ID NO: 1648 - DNA, 18 bp, Artificial Sequence
  Description of Artificial Sequence: antisense oligonucleotide
gcaagggtaaaattctag

SEQ ID NO: 1649 - DNA, 18 bp, Artificial Sequence
  Description of Artificial Sequence: antisense oligonucleotide
agtgcaagggtaaaattc

SEQ ID NO: 1650 - DNA, 15 bp, Artificial Sequence
  Description of Artificial Sequence: antisense oligonucleotide
aaacaggcctccact

SEQ ID NO: 1651 - DNA, 18 bp, Artificial Sequence
  Description of Artificial Sequence: antisense oligonucleotide
cttggttaattccaatgg

SEQ ID NO: 1652 - DNA, 18 bp, Artificial Sequence
  Description of Artificial Sequence: antisense oligonucleotide
aggcaactcccattagtt

SEQ ID NO: 1653 - DNA, 18 bp, Artificial Sequence
  Description of Artificial Sequence: antisense oligonucleotide
tactactaaggcacaggg

SEQ ID NO: 1654 - DNA, 18 bp, Artificial Sequence
  Description of Artificial Sequence: antisense oligonucleotide
aatactactaaggcacag

SEQ ID NO: 1655 - DNA, 18 bp, Artificial Sequence
  Description of Artificial Sequence: antisense oligonucleotide
gtacatcttcaagtcttc

SEQ ID NO: 1656 - DNA, 14 bp, Artificial Sequence
  Description of Artificial Sequence: antisense oligonucleotide
ggagtggacatgat

SEQ ID NO: 1657 - DNA, 18 bp, Artificial Sequence
  Description of Artificial Sequence: antisense oligonucleotide
aagaagatgaagcctttg

SEQ ID NO: 1658 - DNA, 18 bp, Artificial Sequence
  Description of Artificial Sequence: antisense oligonucleotide
ccgtcttactcttcttgg

SEQ ID NO: 1659 - DNA, 17 bp, Artificial Sequence
  Description of Artificial Sequence: antisense oligonucleotide
ccgatacaattccaagg

SEQ ID NO: 1660 - DNA, 15 bp, Artificial Sequence
  Description of Artificial Sequence: antisense oligonucleotide
ccttttccttctgag

SEQ ID NO: 1661 - DNA, 14 bp, Artificial Sequence
  Description of Artificial Sequence: antisense oligonucleotide
ctgttgcaagtacg

SEQ ID NO: 1662 - DNA, 14 bp, Artificial Sequence
  Description of Artificial Sequence: antisense oligonucleotide
cagaagcagagggc

SEQ ID NO: 1663 - DNA, 15 bp, Artificial Sequence
  Description of Artificial Sequence: antisense oligonucleotide
cctcagaagcagagg

SEQ ID NO: 1664 - DNA, 14 bp, Artificial Sequence
  Description of Artificial Sequence: antisense oligonucleotide
ctcctcagaagcag

SEQ ID NO: 1665 - DNA, 14 bp, Artificial Sequence
  Description of Artificial Sequence: antisense oligonucleotide
acaggctggtggca

SEQ ID NO: 1666 - DNA, 16 bp, Artificial Sequence
  Description of Artificial Sequence: antisense oligonucleotide
ccactctcaaacaggc

SEQ ID NO: 1667 - DNA, 14 bp, Artificial Sequence
  Description of Artificial Sequence: antisense oligonucleotide
acggtagccgaagc

SEQ ID NO: 1668 - DNA, 15 bp, Artificial Sequence
  Description of Artificial Sequence: antisense oligonucleotide
gacggtagccgaagc

SEQ ID NO: 1669 - DNA, 14 bp, Artificial Sequence
  Description of Artificial Sequence: antisense oligonucleotide
ggccagacggtagc

SEQ ID NO: 1670 - DNA, 18 bp, Artificial Sequence
  Description of Artificial Sequence: antisense oligonucleotide
gtgtagggccagacggta

SEQ ID NO: 1671 - DNA, 18 bp, Artificial Sequence
  Description of Artificial Sequence: antisense oligonucleotide
ccgaagccatttttcagg

SEQ ID NO: 1672 - DNA, 17 bp, Artificial Sequence
  Description of Artificial Sequence: antisense oligonucleotide
ccccgaagccatttttc

SEQ ID NO: 1673 - DNA, 14 bp, Artificial Sequence
  Description of Artificial Sequence: antisense oligonucleotide
ggttgatgtcgtcc

SEQ ID NO: 1674 - DNA, 15 bp, Artificial Sequence
  Description of Artificial Sequence: antisense oligonucleotide
gcttgagacactcgc

SEQ ID NO: 1675 - DNA, 14 bp, Artificial Sequence
  Description of Artificial Sequence: antisense oligonucleotide
ccggacccgtccat

SEQ ID NO: 1676 - DNA, 14 bp, Artificial Sequence
  Description of Artificial Sequence: antisense oligonucleotide
gcttgctttactgc

SEQ ID NO: 1677 - DNA, 14 bp, Artificial Sequence
  Description of Artificial Sequence: antisense oligonucleotide
ggttgctctgagac

SEQ ID NO: 1678 - DNA, 14 bp, Artificial Sequence
  Description of Artificial Sequence: antisense oligonucleotide
gccacagtcatgcc

SEQ ID NO: 1679 - DNA, 14 bp, Artificial Sequence
  Description of Artificial Sequence: antisense oligonucleotide
cgggcatgctggcg

SEQ ID NO: 1680 - DNA, 18 bp, Artificial Sequence
  Description of Artificial Sequence: antisense oligonucleotide
gtgaagttcaggatgatc

SEQ ID NO: 1681 - DNA, 14 bp, Artificial Sequence
  Description of Artificial Sequence: antisense oligonucleotide
ccagtgcctcatgg

SEQ ID NO: 1682 - DNA, 15 bp, Artificial Sequence
  Description of Artificial Sequence: antisense oligonucleotide
cagtgttctccatgg

SEQ ID NO: 1683 - DNA, 15 bp, Artificial Sequence
  Description of Artificial Sequence: antisense oligonucleotide
ctgtaccagaccgag

SEQ ID NO: 1684 - DNA, 15 bp, Artificial Sequence
  Description of Artificial Sequence: antisense oligonucleotide
gcatactgtttcagc

SEQ ID NO: 1685 - DNA, 15 bp, Artificial Sequence
  Description of Artificial Sequence: antisense oligonucleotide
gccatcagctccttg

SEQ ID NO: 1686 - DNA, 15 bp, Artificial Sequence
  Description of Artificial Sequence: antisense oligonucleotide
ccacaccatagatgg

SEQ ID NO: 1687 - DNA, 15 bp, Artificial Sequence
  Description of Artificial Sequence: antisense oligonucleotide
gctggagcagtttcc

SEQ ID NO: 1688 - DNA, 14 bp, Artificial Sequence
  Description of Artificial Sequence: antisense oligonucleotide
ctcgcttctgctgc

SEQ ID NO: 1689 - DNA, 14 bp, Artificial Sequence
  Description of Artificial Sequence: antisense oligonucleotide
accgtggcaaagcg

SEQ ID NO: 1690 - DNA, 14 bp, Artificial Sequence
  Description of Artificial Sequence: antisense oligonucleotide
aggtgacaccgtgg

SEQ ID NO: 1691 - DNA, 16 bp, Artificial Sequence
  Description of Artificial Sequence: antisense oligonucleotide
gacttgattccttcag

SEQ ID NO: 1692 - DNA, 17 bp, Artificial Sequence
  Description of Artificial Sequence: antisense oligonucleotide
ggatttgacttgattcc

SEQ ID NO: 1693 - DNA, 14 bp, Artificial Sequence
  Description of Artificial Sequence: antisense oligonucleotide
gctgctgttcatgg

SEQ ID NO: 1694 - DNA, 17 bp, Artificial Sequence
  Description of Artificial Sequence: antisense oligonucleotide
ccgtttctttcagtagg

SEQ ID NO: 1695 - DNA, 14 bp, Artificial Sequence
  Description of Artificial Sequence: antisense oligonucleotide
cttgaagtaggagc

SEQ ID NO: 1696 - DNA, 14 bp, Artificial Sequence
  Description of Artificial Sequence: antisense oligonucleotide
cgctcctacatggc

SEQ ID NO: 1697 - DNA, 15 bp, Artificial Sequence
  Description of Artificial Sequence: antisense oligonucleotide
gatgaggtacaggcc

SEQ ID NO: 1698 - DNA, 15 bp, Artificial Sequence
  Description of Artificial Sequence: antisense oligonucleotide
gtagatgaggtacag

SEQ ID NO: 1699 - DNA, 15 bp, Artificial Sequence
  Description of Artificial Sequence: antisense oligonucleotide
gagtagatgaggtac

SEQ ID NO: 1700 - DNA, 14 bp, Artificial Sequence
  Description of Artificial Sequence: antisense oligonucleotide
cctgggagtagatg

SEQ ID NO: 1701 - DNA, 14 bp, Artificial Sequence
  Description of Artificial Sequence: antisense oligonucleotide
ggacctgggagtag

SEQ ID NO: 1702 - DNA, 14 bp, Artificial Sequence
  Description of Artificial Sequence: antisense oligonucleotide
acatgggtggaggg

SEQ ID NO: 1703 - DNA, 14 bp, Artificial Sequence
  Description of Artificial Sequence: antisense oligonucleotide
gtgctcatggtgtc

SEQ ID NO: 1704 - DNA, 15 bp, Artificial Sequence
  Description of Artificial Sequence: antisense oligonucleotide
ctttcagtgctcatg

SEQ ID NO: 1705 - DNA, 15 bp, Artificial Sequence
  Description of Artificial Sequence: antisense oligonucleotide
tgctttcagtgctca

SEQ ID NO: 1706 - DNA, 15 bp, Artificial Sequence
  Description of Artificial Sequence: antisense oligonucleotide
gatgatctgactgcc

SEQ ID NO: 1707 - DNA, 16 bp, Artificial Sequence
  Description of Artificial Sequence: antisense oligonucleotide
gttcgagaagatgatc

SEQ ID NO: 1708 - DNA, 15 bp, Artificial Sequence
  Description of Artificial Sequence: antisense oligonucleotide
gggttcgagaagatg

SEQ ID NO: 1709 - DNA, 16 bp, Artificial Sequence
  Description of Artificial Sequence: antisense oligonucleotide
ggtttgctacaacatg

SEQ ID NO: 1710 - DNA, 15 bp, Artificial Sequence
  Description of Artificial Sequence: antisense oligonucleotide
cagcttgagggtttg

SEQ ID NO: 1711 - DNA, 14 bp, Artificial Sequence
  Description of Artificial Sequence: antisense oligonucleotide
tgcccctcagcttg

SEQ ID NO: 1712 - DNA, 15 bp, Artificial Sequence
  Description of Artificial Sequence: antisense oligonucleotide
gacacacactatctc

SEQ ID NO: 1713 - DNA, 16 bp, Artificial Sequence
  Description of Artificial Sequence: antisense oligonucleotide
gcagccatctttattc

SEQ ID NO: 1714 - DNA, 14 bp, Artificial Sequence
  Description of Artificial Sequence: antisense oligonucleotide
gttcagcagccatc

SEQ ID NO: 1715 - DNA, 14 bp, Artificial Sequence
  Description of Artificial Sequence: antisense oligonucleotide
tggttcagcagcca

SEQ ID NO: 1716 - DNA, 16 bp, Artificial Sequence
  Description of Artificial Sequence: antisense oligonucleotide
ctactggttcagcagc

SEQ ID NO: 1717 - DNA, 14 bp, Artificial Sequence
  Description of Artificial Sequence: antisense oligonucleotide
tctactggttcagc

SEQ ID NO: 1718 - DNA, 16 bp, Artificial Sequence
  Description of Artificial Sequence: antisense oligonucleotide
gccacaaagttgatgc

SEQ ID NO: 1719 - DNA, 16 bp, Artificial Sequence
  Description of Artificial Sequence: antisense oligonucleotide
cattgccacaaagttg

SEQ ID NO: 1720 - DNA, 16 bp, Artificial Sequence
  Description of Artificial Sequence: antisense oligonucleotide
gagaacttggtcattc

SEQ ID NO: 1721 - DNA, 16 bp, Artificial Sequence
  Description of Artificial Sequence: antisense oligonucleotide
ggtcaatgaagagaac

SEQ ID NO: 1722 - DNA, 14 bp, Artificial Sequence
  Description of Artificial Sequence: antisense oligonucleotide
cgatttccttggtc

SEQ ID NO: 1723 - DNA, 15 bp, Artificial Sequence
  Description of Artificial Sequence: antisense oligonucleotide
ccgatttccttggtc

SEQ ID NO: 1724 - DNA, 18 bp, Artificial Sequence
  Description of Artificial Sequence: antisense oligonucleotide
caaatagaggccgatttc

SEQ ID NO: 1725 - DNA, 14 bp, Artificial Sequence
  Description of Artificial Sequence: antisense oligonucleotide
caaatagaggccga

SEQ ID NO: 1726 - DNA, 14 bp, Artificial Sequence
  Description of Artificial Sequence: antisense oligonucleotide
cctctaggctggct

SEQ ID NO: 1727 - DNA, 15 bp, Artificial Sequence
  Description of Artificial Sequence: antisense oligonucleotide
catacctctaggctg

SEQ ID NO: 1728 - DNA, 14 bp, Artificial Sequence
  Description of Artificial Sequence: antisense oligonucleotide
agccatacctctag

SEQ ID NO: 1729 - DNA, 15 bp, Artificial Sequence
  Description of Artificial Sequence: antisense oligonucleotide
cagccatacctctag

SEQ ID NO: 1730 - DNA, 17 bp, Artificial Sequence
  Description of Artificial Sequence: antisense oligonucleotide
cacagagatagttacag

SEQ ID NO: 1731 - DNA, 17 bp, Artificial Sequence
  Description of Artificial Sequence: antisense oligonucleotide
gtcttcgttttgaacag

SEQ ID NO: 1732 - DNA, 18 bp, Artificial Sequence
  Description of Artificial Sequence: antisense oligonucleotide
ctagtcttcgttttgaac

SEQ ID NO: 1733 - DNA, 18 bp, Artificial Sequence
  Description of Artificial Sequence: antisense oligonucleotide
tagctagtcttcgttttg

SEQ ID NO: 1734 - DNA, 13 bp, Artificial Sequence
  Description of Artificial Sequence: antisense oligonucleotide
gagccactgcgcc

SEQ ID NO: 1735 - DNA, 14 bp, Artificial Sequence
  Description of Artificial Sequence: antisense oligonucleotide
cgtgagccactgcg

SEQ ID NO: 1736 - DNA, 15 bp, Artificial Sequence
  Description of Artificial Sequence: antisense oligonucleotide
cgtaacgatcactgg

SEQ ID NO: 1737 - DNA, 15 bp, Artificial Sequence
  Description of Artificial Sequence: antisense oligonucleotide
gcactcgtaacgatc

SEQ ID NO: 1738 - DNA, 14 bp, Artificial Sequence
  Description of Artificial Sequence: antisense oligonucleotide
ggagcactcgtaac

SEQ ID NO: 1739 - DNA, 14 bp, Artificial Sequence
  Description of Artificial Sequence: antisense oligonucleotide
catcatcctgaggt

SEQ ID NO: 1740 - DNA, 16 bp, Artificial Sequence
  Description of Artificial Sequence: antisense oligonucleotide
cagtatcatcatcctg

SEQ ID NO: 1741 - DNA, 16 bp, Artificial Sequence
  Description of Artificial Sequence: antisense oligonucleotide
ctcagtatcatcatcc

SEQ ID NO: 1742 - DNA, 18 bp, Artificial Sequence
  Description of Artificial Sequence: antisense oligonucleotide
ctaaaagtatgtgccatc

SEQ ID NO: 1743 - DNA, 14 bp, Artificial Sequence
  Description of Artificial Sequence: antisense oligonucleotide
cacatcgcctctct

SEQ ID NO: 1744 - DNA, 18 bp, Artificial Sequence
  Description of Artificial Sequence: antisense oligonucleotide
gcttcacagtcacatcgc

SEQ ID NO: 1745 - DNA, 16 bp, Artificial Sequence
  Description of Artificial Sequence: antisense oligonucleotide
ggaaggcttcacagtc

SEQ ID NO: 1746 - DNA, 18 bp, Artificial Sequence
  Description of Artificial Sequence: antisense oligonucleotide
cctgtgacttgagaattg

SEQ ID NO: 1747 - DNA, 14 bp, Artificial Sequence
  Description of Artificial Sequence: antisense oligonucleotide
ggaagacctgtgac

SEQ ID NO: 1748 - DNA, 18 bp, Artificial Sequence
  Description of Artificial Sequence: antisense oligonucleotide
ctctgctccacatatttg

SEQ ID NO: 1749 - DNA, 15 bp, Artificial Sequence
  Description of Artificial Sequence: antisense oligonucleotide
caacgaagatctctg

SEQ ID NO: 1750 - DNA, 14 bp, Artificial Sequence
  Description of Artificial Sequence: antisense oligonucleotide
caacaccaacgaag

SEQ ID NO: 1751 - DNA, 14 bp, Artificial Sequence
  Description of Artificial Sequence: antisense oligonucleotide
ggtcttctgtttgc

SEQ ID NO: 1752 - DNA, 18 bp, Artificial Sequence
  Description of Artificial Sequence: antisense oligonucleotide
cgatgaagtggtaggaag

SEQ ID NO: 1753 - DNA, 14 bp, Artificial Sequence
  Description of Artificial Sequence: antisense oligonucleotide
ggttgcatggaagc

SEQ ID NO: 1754 - DNA, 15 bp, Artificial Sequence
  Description of Artificial Sequence: antisense oligonucleotide
ggtcacaaacttgcc

SEQ ID NO: 1755 - DNA, 17 bp, Artificial Sequence
  Description of Artificial Sequence: antisense oligonucleotide
ctgatttggtccactag

SEQ ID NO: 1756 - DNA, 16 bp, Artificial Sequence
  Description of Artificial Sequence: antisense oligonucleotide
catgttagcactgttc

SEQ ID NO: 1757 - DNA, 16 bp, Artificial Sequence
  Description of Artificial Sequence: antisense oligonucleotide
ggtcttgatgtactcc

SEQ ID NO: 1758 - DNA, 17 bp, Artificial Sequence
  Description of Artificial Sequence: antisense oligonucleotide
ccacctaaagagagatc

SEQ ID NO: 1759 - DNA, 16 bp, Artificial Sequence
  Description of Artificial Sequence: antisense oligonucleotide
cttgtactgcaccatc

SEQ ID NO: 1760 - DNA, 16 bp, Artificial Sequence
  Description of Artificial Sequence: antisense oligonucleotide
gccagttaagaagatg

SEQ ID NO: 1761 - DNA, 17 bp, Artificial Sequence
  Description of Artificial Sequence: antisense oligonucleotide
gagatcatgatccatgg

SEQ ID NO: 1762 - DNA, 17 bp, Artificial Sequence
  Description of Artificial Sequence: antisense oligonucleotide
gtagtgtcccaatagtg

SEQ ID NO: 1763 - DNA, 16 bp, Artificial Sequence
  Description of Artificial Sequence: antisense oligonucleotide
cttcctcatcattccc

SEQ ID NO: 1764 - DNA, 15 bp, Artificial Sequence
  Description of Artificial Sequence: antisense oligonucleotide
cacaagcttttcgac

What is claimed is:

1. A method for the selection and preparation of an effective antisense oligonucleotide for a nucleic acid comprising the steps of
designing an antisense oligonucleotide corresponding to a target nucleic acid sequence, such that
a) the antisense oligonucleotide comprises at least 8 nucleic acid residues,
b) the antisense oligonucleotide comprises a maximum of twelve elements, each the twelve elements being a nucleotide capable of forming three hydrogen bonds to a cytosine base,
c) the antisense oligonucleotide does not contain four or more consecutive elements,
d) the antisense oligonucleotide does not contain two or more series of three consecutive elements, and
e) the ratio of residues forming two hydrogen bonds each with the target nucleic acid sequence with respect to residues forming three hydrogen bonds each with the target nucleic acid sequence is $$\frac{3H\text{-bond-}R}{3H\text{-bond-}R + 2H\text{-bond-}R} \geq 0.29$$

wherein
3H-bond-R=residues forming three hydrogen bonds per residue and
2H-bond-R=residues forming two hydrogen bonds per residue,
generating the designed antisense oligonucleotide, and
synthesizing the generated antisense oligonucleotide.

2. The method according to claim 1, wherein the four or more consecutive elements not contained in the antisense oligonucleotide are each guanosine.

3. The method according to claim 1, wherein the three consecutive elements in the two or more series not contained in the antisense oligonucleotide are each guanosine.

4. The method according to claim 1, wherein the generated oligonucleotide complies with the following specification $$\frac{3H\text{-bond-}R}{3H\text{-bond-}R + 2H\text{-bond-}R} = 0.33 \text{ to } 0.86.$$

5. The method according to claim 1, wherein the generated oligonucleotides are modified for higher nuclease resistance than naturally occurring oligo- or polynucleotides.

6. The method according to claim 5, wherein the generated oligonucleotides are modified at the bases, the sugars or the linkages of the oligonucleotides, preferably by phosphorothioate (S-ODN) internucleotide linkages, and/or methylphosphonate internucleotide linkages, N'3->P5' phosphoramidate linkages, peptide linkages or 2'-methoxyethoxy modifications of the sugar or modifications of the bases.

7. The method according to claim 6, wherein the oligonucleotide has at least two different types of modifications.

8. The method according to claim 1, wherein the oligonucleotides are reacted with folic acid, hormones such as steroid hormones or corticosteroids or derivatives thereof by linking the oligonucleotides covalently to or mixing with folic acid, hormones such as steroid hormones or corticosteroids, peptides, proteoglycans, glycolipids or phospholipids.

9. An antisense oligonucleotide consisting of SEQ ID NO: 1754.

* * * * *